(12) United States Patent
Zhou

(10) Patent No.: US 11,542,504 B2
(45) Date of Patent: Jan. 3, 2023

(54) COMPOUNDS AND METHODS FOR MODULATING ATXN1

(71) Applicant: Ionis Pharmaceuticals, Inc., Carlsbad, CA (US)

(72) Inventor: Keming Zhou, San Diego, CA (US)

(73) Assignee: Ionis Pharmaceuticals, Inc., Carlsbad, CA (US)

( * ) Notice: Subject to any disclaimer, the term of this patent is extended or adjusted under 35 U.S.C. 154(b) by 5 days.

(21) Appl. No.: 17/751,450

(22) Filed: May 23, 2022

(65) Prior Publication Data

US 2022/0290146 A1 Sep. 15, 2022

Related U.S. Application Data

(63) Continuation of application No. PCT/US2021/030203, filed on Apr. 30, 2021.

(60) Provisional application No. 63/019,089, filed on May 1, 2020.

(51) Int. Cl.
| | |
|---|---|
| C07H 21/04 | (2006.01) |
| C12N 15/113 | (2010.01) |
| A61P 25/00 | (2006.01) |
| A61K 31/712 | (2006.01) |
| A61K 35/30 | (2015.01) |
| A61K 47/02 | (2006.01) |

(52) U.S. Cl.
CPC .......... *C12N 15/113* (2013.01); *A61K 31/712* (2013.01); *A61K 35/30* (2013.01); *A61K 47/02* (2013.01); *A61P 25/00* (2018.01); *C12N 2310/11* (2013.01); *C12N 2310/315* (2013.01); *C12N 2310/3231* (2013.01); *C12N 2310/3341* (2013.01); *C12N 2310/341* (2013.01)

(58) Field of Classification Search
None
See application file for complete search history.

(56) References Cited

U.S. PATENT DOCUMENTS

| | | |
|---|---|---|
| 3,687,808 A | 8/1972 | Merigan et al. |
| 4,415,732 A | 11/1983 | Caruthers et al. |
| 4,469,863 A | 9/1984 | Ts'o et al. |
| 4,476,301 A | 10/1984 | Imbach et al. |
| 4,500,707 A | 2/1985 | Caruthers et al. |
| 4,725,677 A | 2/1988 | Koster et al. |
| 4,845,205 A | 7/1989 | Huynh Dinh et al. |
| 4,973,679 A | 11/1990 | Caruthers et al. |
| 4,981,957 A | 1/1991 | Lebleu et al. |
| 5,013,830 A | 5/1991 | Ohutsuka et al. |
| 5,023,243 A | 6/1991 | Tullis |
| 5,034,506 A | 7/1991 | Summerton et al. |
| 5,118,800 A | 6/1992 | Smith et al. |
| 5,130,302 A | 7/1992 | Spielvogel et al. |
| 5,132,418 A | 7/1992 | Caruthers et al. |
| 5,134,066 A | 7/1992 | Rogers et al. |
| RE34,036 E | 8/1992 | McGeehan |
| 5,149,797 A | 9/1992 | Pederson et al. |
| 5,166,315 A | 11/1992 | Summerton et al. |
| 5,175,273 A | 12/1992 | Bischofberger et al. |
| 5,177,196 A | 1/1993 | Meyer, Jr. et al. |
| 5,177,198 A | 1/1993 | Spielvogel et al. |
| 5,188,897 A | 2/1993 | Suhadolnik et al. |
| 5,194,599 A | 3/1993 | Froehler et al. |
| 5,214,134 A | 5/1993 | Weis et al. |
| 5,216,141 A | 6/1993 | Benner |
| 5,220,007 A | 6/1993 | Pederson et al. |
| 5,223,618 A | 6/1993 | Cook et al. |
| 5,235,033 A | 8/1993 | Summerton et al. |
| 5,256,775 A | 10/1993 | Froehler |
| 5,264,423 A | 11/1993 | Cohen et al. |
| 5,264,562 A | 11/1993 | Matteucci |
| 5,264,564 A | 11/1993 | Matteucci |
| 5,185,444 A | 12/1993 | Summerton et al. |
| 5,276,019 A | 1/1994 | Cohen et al. |
| 5,286,717 A | 2/1994 | Cohen et al. |
| 5,319,080 A | 6/1994 | Leumann |
| 5,321,131 A | 6/1994 | Agrawal et al. |
| 5,359,044 A | 10/1994 | Cook et al. |
| 5,366,878 A | 11/1994 | Pederson et al. |

(Continued)

FOREIGN PATENT DOCUMENTS

| | | |
|---|---|---|
| WO | WO 2002/058626 | 8/2002 |
| WO | WO 2004/044123 | 5/2004 |

(Continued)

OTHER PUBLICATIONS

Branch et al., "A good antisense molecule is hard to find," TIBS (1998) 23:45-50.

(Continued)

*Primary Examiner* — Kimberly Chong

(74) *Attorney, Agent, or Firm* — McNeill Baur PLLC

(57) ABSTRACT

Provided are compounds, methods, and pharmaceutical compositions for reducing the amount or activity of ATXN1 RNA in a cell or subject, and in certain instances reducing the amount of ATXN1 in a cell or subject. Such compounds, methods, and pharmaceutical compositions are useful to ameliorate at least one symptom or hallmark of a neurodegenerative disease. Such symptoms and hallmarks include gait and limb ataxia, cognitive impairments, difficulty with speaking and swallowing, atrophy of the cerebellum and brainstem in magnetic resonance imaging (MRI), neurochemical abnormalities in the cerebellum and brainstem detected via magnetic resonance spectroscopy (MRS), and death within 10-15 years of symptom onset. Such neurodegenerative diseases include Spinocerebellar ataxia type 1.

30 Claims, No Drawings

Specification includes a Sequence Listing.

(56) References Cited

U.S. PATENT DOCUMENTS

| | | |
|---|---|---|
| 5,367,066 A | 11/1994 | Urdea et al. |
| 5,378,825 A | 1/1995 | Cook et al. |
| 5,386,023 A | 1/1995 | Sanghvi et al. |
| 5,393,878 A | 2/1995 | Leumann |
| 5,399,676 A | 3/1995 | Froehler |
| 5,403,711 A | 4/1995 | Walder et al. |
| 5,405,938 A | 4/1995 | Sumerton et al. |
| 5,405,939 A | 4/1995 | Suhadolnik et al. |
| 5,432,272 A | 7/1995 | Benner |
| 5,434,257 A | 7/1995 | Matteucci |
| 5,446,137 A | 8/1995 | Maag et al. |
| 5,453,496 A | 9/1995 | Caruthers et al. |
| 5,455,233 A | 10/1995 | Spielvogel et al. |
| 5,457,187 A | 10/1995 | Gmelner et al. |
| 5,457,191 A | 10/1995 | Cook et al. |
| 5,459,255 A | 10/1995 | Cook et al. |
| 5,466,677 A | 11/1995 | Baxter et al. |
| 5,466,786 A | 11/1995 | Burh et al. |
| 5,470,967 A | 11/1995 | Huie et al. |
| 5,476,925 A | 12/1995 | Letsinger et al. |
| 5,484,908 A | 1/1996 | Froehler et al. |
| 5,489,677 A | 2/1996 | Sanghvi et al. |
| 5,491,133 A | 2/1996 | Walder et al. |
| 5,502,177 A | 3/1996 | Matteucci et al. |
| 5,508,270 A | 4/1996 | Baxter et al. |
| 5,514,785 A | 5/1996 | Van Ness et al. |
| 5,519,126 A | 5/1996 | Hecht |
| 5,519,134 A | 5/1996 | Acevedo et al. |
| 5,525,711 A | 6/1996 | Hawkins et al. |
| 5,527,899 A | 6/1996 | Froehler |
| 5,536,821 A | 7/1996 | Agrawal et al. |
| 5,541,306 A | 7/1996 | Agrawal et al. |
| 5,541,307 A | 7/1996 | Cook et al. |
| 5,550,111 A | 8/1996 | Suhadolnik et al. |
| 5,552,540 A | 9/1996 | Haralambidis |
| 5,561,225 A | 10/1996 | Maddry et al. |
| 5,563,253 A | 10/1996 | Agrawal et al. |
| 5,565,350 A | 10/1996 | Kmiec |
| 5,565,555 A | 10/1996 | Froehler et al. |
| 5,567,811 A | 10/1996 | Mistura et al. |
| 5,571,799 A | 11/1996 | Tkachuk et al. |
| 5,576,427 A | 11/1996 | Cook et al. |
| 5,587,361 A | 12/1996 | Cook et al. |
| 5,587,469 A | 12/1996 | Cook et al. |
| 5,587,470 A | 12/1996 | Cook et al. |
| 5,591,722 A | 1/1997 | Montgomery et al. |
| 5,594,121 A | 1/1997 | Froehler et al. |
| 5,596,086 A | 1/1997 | Matteucci |
| 5,596,091 A | 1/1997 | Switzer |
| 5,597,909 A | 1/1997 | Urdea et al. |
| 5,602,240 A | 2/1997 | De Mesmaeker et al. |
| 5,608,046 A | 3/1997 | Cook et al. |
| 5,610,289 A | 3/1997 | Cook et al. |
| 5,610,300 A | 3/1997 | Altmann et al. |
| 5,614,617 A | 3/1997 | Cook et al. |
| 5,618,704 A | 4/1997 | Sanghvi et al. |
| 5,623,065 A | 4/1997 | Cook et al. |
| 5,623,070 A | 4/1997 | Cook et al. |
| 5,625,050 A | 4/1997 | Beaton et al. |
| 5,627,053 A | 5/1997 | Usman et al. |
| 5,633,360 A | 5/1997 | Bishofberger et al. |
| 5,639,873 A | 6/1997 | Barascut et al. |
| 5,645,985 A | 7/1997 | Froehler et al. |
| 5,646,265 A | 7/1997 | McGee |
| 5,646,269 A | 7/1997 | Matteucci |
| 5,652,355 A | 7/1997 | Metelev et al. |
| 5,652,356 A | 7/1997 | Agrawal |
| 5,663,312 A | 9/1997 | Chaturvedula |
| 5,670,633 A | 9/1997 | Cook et al. |
| 5,672,697 A | 9/1997 | Buhr et al. |
| 5,677,437 A | 10/1997 | Teng et al. |
| 5,677,439 A | 10/1997 | Weis et al. |
| 5,681,941 A | 10/1997 | Cook et al. |
| 5,698,685 A | 12/1997 | Summerton et al. |
| 5,700,920 A | 12/1997 | Altmann et al. |
| 5,700,922 A | 12/1997 | Cook |
| 5,721,218 A | 2/1998 | Froehler |
| 5,750,692 A | 5/1998 | Cook et al. |
| 5,763,588 A | 6/1998 | Matteucci et al. |
| 5,792,608 A | 8/1998 | Swaminathan et al. |
| 5,792,847 A | 8/1998 | Burh et al. |
| 5,801,154 A | 9/1998 | Baracchini et al. |
| 5,808,027 A | 9/1998 | Cook et al. |
| 5,830,653 A | 11/1998 | Froehler et al. |
| 5,859,221 A | 1/1999 | Cook et al. |
| 5,948,903 A | 9/1999 | Cook et al. |
| 5,994,517 A | 11/1999 | Ts'O |
| 6,005,087 A | 12/1999 | Cook et al. |
| 6,005,096 A | 12/1999 | Matteucci et al. |
| 6,166,199 A | 12/2000 | Cook et al. |
| 6,300,319 B1 | 10/2001 | Manoharan |
| 6,426,220 B1 | 7/2002 | Bennett et al. |
| 6,525,191 B1 | 2/2003 | Ramasamy |
| 6,531,584 B1 | 3/2003 | Cook et al. |
| 6,582,908 B2 | 6/2003 | Fodor et al. |
| 6,600,032 B1 | 7/2003 | Manoharan et al. |
| 6,660,720 B2 | 12/2003 | Manoharan |
| 6,770,748 B2 | 8/2004 | Imanishi et al. |
| 7,015,315 B1 | 3/2006 | Cook et al. |
| 7,053,207 B2 | 5/2006 | Wengel et al. |
| 7,101,993 B1 | 9/2006 | Cook et al. |
| 7,262,177 B2 | 8/2007 | Ts'o et al. |
| 7,399,845 B2 | 7/2008 | Seth et al. |
| 7,427,672 B2 | 9/2008 | Imanishi et al. |
| 7,491,805 B2 | 2/2009 | Vargeese et al. |
| 7,547,684 B2 | 6/2009 | Seth et al. |
| 7,569,686 B1 | 8/2009 | Bhat et al. |
| 7,666,854 B2 | 2/2010 | Seth et al. |
| 7,691,997 B2 | 4/2010 | Khvorova et al. |
| 7,696,345 B2 | 4/2010 | Allerson et al. |
| 7,723,509 B2 | 5/2010 | Manoharan et al. |
| 7,741,457 B2 | 6/2010 | Swayze et al. |
| 7,750,131 B2 | 7/2010 | Seth et al. |
| 7,875,733 B2 | 1/2011 | Bhat et al. |
| 7,939,677 B2 | 5/2011 | Bhat et al. |
| 8,022,193 B2 | 9/2011 | Swayze et al. |
| 8,030,467 B2 | 10/2011 | Seth et al. |
| 8,080,644 B2 | 12/2011 | Wengel et al. |
| 8,088,746 B2 | 1/2012 | Seth et al. |
| 8,088,904 B2 | 1/2012 | Swayze et al. |
| 8,106,022 B2 | 1/2012 | Manoharan et al. |
| 8,124,745 B2 | 2/2012 | Allerson et al. |
| 8,153,365 B2 | 4/2012 | Wengel et al. |
| 8,268,980 B2 | 9/2012 | Seth et al. |
| 8,278,283 B2 | 10/2012 | Seth et al. |
| 8,278,425 B2 | 10/2012 | Prakash et al. |
| 8,278,426 B2 | 10/2012 | Seth et al. |
| 8,440,803 B2 | 5/2013 | Swayze et al. |
| 8,501,805 B2 | 8/2013 | Seth et al. |
| 8,530,640 B2 | 9/2013 | Seth et al. |
| 8,546,556 B2 | 10/2013 | Seth et al. |
| RE44,779 E | 2/2014 | Imanishi et al. |
| 8,828,956 B2 | 9/2014 | Manoharan et al. |
| 9,005,906 B2 | 4/2015 | Swayze et al. |
| 9,012,421 B2 | 4/2015 | Migawa et al. |
| 9,127,276 B2 | 8/2015 | Prakash et al. |
| 9,290,760 B2 | 3/2016 | Rajeev et al. |
| 2001/0053519 A1 | 12/2001 | Fodor et al. |
| 2003/0158403 A1 | 8/2003 | Manoharan et al. |
| 2003/0175906 A1 | 9/2003 | Manoharan et al. |
| 2003/0228597 A1 | 12/2003 | Cowsert et al. |
| 2004/0171570 A1 | 9/2004 | Allerson et al. |
| 2005/0130923 A1 | 6/2005 | Bhat et al. |
| 2005/0244851 A1 | 11/2005 | Blume et al. |
| 2006/0148740 A1 | 7/2006 | Platenburg |
| 2007/0031844 A1 | 2/2007 | Khvorova et al. |
| 2008/0039618 A1 | 2/2008 | Allerson et al. |
| 2010/0190837 A1 | 7/2010 | Migawa et al. |
| 2010/0197762 A1 | 8/2010 | Swayze et al. |
| 2011/0111491 A1 | 5/2011 | Davidson et al. |
| 2013/0130378 A1 | 5/2013 | Manoharan et al. |
| 2014/0107330 A1 | 4/2014 | Freier et al. |
| 2015/0018540 A1 | 1/2015 | Prakash et al. |
| 2015/0184153 A1 | 7/2015 | Freier et al. |

(56) References Cited

U.S. PATENT DOCUMENTS

| | | |
|---|---|---|
| 2015/0191727 A1 | 7/2015 | Migawa et al. |
| 2015/0267195 A1 | 9/2015 | Seth et al. |
| 2015/0275212 A1 | 10/2015 | Albaek et al. |
| 2019/0330639 A1 | 10/2019 | Brown et al. |

FOREIGN PATENT DOCUMENTS

| | | |
|---|---|---|
| WO | WO 2004/047872 | 6/2004 |
| WO | WO 2012/012467 | 1/2012 |
| WO | WO 2018/154439 | 8/2018 |
| WO | WO 2021/222768 | 11/2021 |

OTHER PUBLICATIONS

Chin "On the Preparation and Utilization of Isolated and Purified Oligonucleotides" Document purportedly located on a CD-ROM and contributed to the public collection of the Katherine R. Everett Law Library of the University of North Carolina on Mar. 14, 2002.

Crooke et al., "Basic Principles of Antisense Therapeutics" Antisense Research and Application (1998) Chapter 1:1-50.

Crooke, St., et al., "Antisense Drug Technology" Second Edition, CRC Press (2008) Chapters 1-28.

Egli, et al., "Synthesis, improved antisense activity and structural rationale for the divergent RNA affinities of 3'-fluoro hexitol nucleic acid (FHNA and Ara-FHNA) modified oligonucleotides." J Am Chem (2011) 133(41):16642-16649.

Evers et al., "Targeting Several CAG Expansion Diseases by a Single Antisense Oligonucleotide" PLOS One (2011)6: e24308.

Friedrich et al., "Antisense oligonucleotide-mediated ataxin-1 reduction prolongs survival in SCA1 mice and reveals disease-associated transcriptome profiles" JCI Insight (2018) 3: e123193.

Friedrich et al., "Antisense Oligonucleotides as a Potential Therapeutic for SCA1" Presentation for 6th Ataxia Investigators Meeting (AIM 2016) Orlando, FL (Mar. 29-Apr. 1).

Gao et al., "Antisense RNA Sequences Modulating the Ataxin-1 Message: Molecular Model of Gene Therapy for Spinocerebellar Ataxia Type 1, a Dominant-Acting Unstable Trinucleotide Repeat Disease" Cell Transplantation (2008) 17: 723-734.

Gautschi et al., "Activity of a novel bcl-2/bcl-xLbispecific antisense oligonucleotide against tumors of diverse histologic origins" J. Natl. Cancer Inst. (2001) 93:463-471.

International Search Report for PCT/US21/030203 dated Oct. 27, 2021.

Ju et al., "Beyond the glutamine expansion: influence of post-translational modifications of ataxin-1 in the pathogenesis of spinocerebellar ataxia type 1" Mol Neurobiol (2014) 50: 866-874.

Keiser et al., "RNAi Prevents and Reverses Phenotypes Induced by Mutant Human Ataxin-1" Ann Neurol (2016) 80: 754-765.

Keiser et al., "RNAi of overexpression: Alternative therapies for Spinocerebellar Ataxia Type 1" Neurobiology of Disease (2013) 56: 6-13.

Maher et al., "Comparative hybrid arrest by tandem antisense oligodeoxy ribonucleotides or oligodeoxyribonucleoside methylpbosphonates in a cell-free system" Nucl. Acid. Res. (1988) 16(8):3341-3358.

O'Callaghan et al. "Antisense Oligonucleotide Therapeutic Approach for Suppression of Ataxin-1 Expression: A Safety Assessment" Mol Ther Nucl Acids (2020) 21: 1006-1016.

Ortiz et al., "Spinocerebellar Ataxia Type 1: Molecular Mechanisms of Neurodegeneration and Preclinical Studies" Adv Exp Med Biol (2018) 1049: 135-145.

Reynolds et al., "Rational siRNA design for RNA interference" Nature Biotechnology (2004) 22(3):326-330.

Sanghvi et al., "Heterocyclic Base Modifications in Nucleic Acids and Their Applications in Antisense Oligonucleotides" Antisense Research and Applications (1993) pp. 273-288.

Seth et al., "Short Antisense Oligonucleotides with Novel 2'-4' Conformationaly Restricted Nucleoside Analogues Show Improved Potency Without Increased Toxicity in Animals." J Med Chem (2009) 52:10-13.

Woolf et al., "Specificity of antisense oligonucleotides in vivo" PNAS (1992) 89: 7305-7309.

US 11,542,504 B2

COMPOUNDS AND METHODS FOR MODULATING ATXN1

SEQUENCE LISTING

The present application is being filed along with a Sequence Listing in electronic format. The Sequence Listing is provided as a file entitled BIOL0355USC1SEQ_ST25.txt, created on May 20, 2022, which is 1.32 MB in size. The information in the electronic format of the sequence listing is incorporated herein by reference in its entirety.

FIELD

Provided are compounds, methods, and pharmaceutical compositions for reducing the amount or activity of ATXN1 RNA in a cell or subject, and in certain instances reducing the amount of ATXN1 protein in a cell or subject. Such compounds, methods, and pharmaceutical compositions are useful to ameliorate at least one symptom or hallmark of a neurodegenerative disease. Such symptoms and hallmarks include gait and limb ataxia, cognitive impairments, difficulty with speaking and swallowing, atrophy of the cerebellum and brainstem in magnetic resonance imaging (MRI), neurochemical abnormalities in the cerebellum and brainstem detected via magnetic resonance spectroscopy (MRS), and death within 10-15 years of symptom onset. Such neurodegenerative diseases include Spinocerebellar ataxia type 1.

BACKGROUND

Spinocerebellar ataxia type 1 (SCA1) is a progressive and fatal neurodegenerative disorder that affects 1-2/100,000 individuals worldwide. SCA1 is caused by an expanded CAG repeat in the coding region of gene encoding Ataxin-1, ATXN1. Accumulation of mutant Ataxin-1 protein leads to the degeneration of Purkinje cells and brainstem nuclei. Symptoms and hallmarks of SCA1 include gait and limb ataxia, cognitive impairments, difficulty with speaking and swallowing, atrophy of the cerebellum and brainstem in magnetic resonance imaging (MRI), neurochemical abnormalities in the cerebellum and brainstem detected via magnetic resonance spectroscopy (MRS), and death within 10-15 years of symptom onset (see, e.g., Ju, H., Kokubu, H., and Lim, J., *Mol. Neurobiol.* 50:866-874, 2014; Ortiz, J. P., Orr, H. T., in Polyglutamine Disorders, Nóbrega, C. and Almeida, L., eds., *Advances in Exp. Med. And Biol.*, 1049: 135-145, 2018).

There are no specific therapies for SCA1, with current treatments being limited to supportive treatments for individual symptoms.

Currently there is a lack of acceptable options for treating neurodegenerative diseases such as SCA1. It is therefore an object herein to provide compounds, methods, and pharmaceutical compositions for the treatment of such diseases.

SUMMARY OF THE INVENTION

Provided herein are compounds, methods and pharmaceutical compositions for reducing the amount or activity of ATXN1 RNA, and in certain embodiments reducing the expression of ATXN1 protein in a cell or subject. In certain embodiments, the subject has a neurodegenerative disease. In certain embodiments, the subject has Spinocerebellar ataxia type 1 (SCA1). In certain embodiments, compounds useful for reducing the amount or activity of ATXN1 RNA are oligomeric compounds. In certain embodiments, compounds useful for reducing the amount or activity of ATXN1 RNA are modified oligonucleotides. In certain embodiments, compounds useful for decreasing expression of ATXN1 protein are oligomeric compounds. In certain embodiments, compounds useful for decreasing expression of ATXN1 protein are modified oligonucleotides.

Also provided are methods useful for ameliorating at least one symptom or hallmark of a neurodegenerative disease. In certain embodiments, the neurodegenerative disease is Spinocerebellar ataxia type 1. In certain embodiments, the symptom or hallmark includes gait and limb ataxia, cognitive impairments, difficulty with speaking and swallowing, atrophy of the cerebellum and brainstem in magnetic resonance imaging (MRI), neurochemical abnormalities in the cerebellum and brainstem detected via magnetic resonance spectroscopy (MRS), and death within 10-15 years of symptom onset.

DETAILED DESCRIPTION OF THE INVENTION

It is to be understood that both the foregoing general description and the following detailed description are exemplary and explanatory only and are not restrictive. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting. Also, terms such as "element" or "component" encompass both elements and components comprising one unit and elements and components that comprise more than one subunit, unless specifically stated otherwise.

The section headings used herein are for organizational purposes only and are not to be construed as limiting the subject matter described. All documents, or portions of documents, cited in this application, including, but not limited to, patents, patent applications, articles, books, treatises, and GenBank, ENSEMBL, and NCBI reference sequence records, are hereby expressly incorporated-by-reference for the portions of the document discussed herein, as well as in their entirety.

Definitions

Unless specific definitions are provided, the nomenclature used in connection with, and the procedures and techniques of, analytical chemistry, synthetic organic chemistry, and medicinal and pharmaceutical chemistry described herein are those well-known and commonly used in the art. Where permitted, all patents, applications, published applications and other publications and other data referred to throughout in the disclosure are incorporated by reference herein in their entirety.

Unless otherwise indicated, the following terms have the following meanings:

Definitions

As used herein, "2'-deoxynucleoside" means a nucleoside comprising a 2'-H(H) deoxyfuranosyl sugar moiety. In certain embodiments, a 2'-deoxynucleoside is a 2'-β-D-deoxynucleoside and comprises a 2'-β-D-deoxyribosyl sugar moiety, which has the β-D ribosyl configuration as found in naturally occurring deoxyribonucleic acids (DNA). In certain embodiments, a 2'-deoxynucleoside may comprise a modified nucleobase or may comprise an RNA nucleobase (uracil).

As used herein, "2'-MOE" means a 2'-OCH$_2$CH$_2$OCH$_3$ group in place of the 2'—OH group of a furanosyl sugar moiety. A "2'-MOE sugar moiety" means a sugar moiety with a 2'-OCH$_2$CH$_2$OCH$_3$ group in place of the 2'—OH group of a furanosyl sugar moiety. Unless otherwise indicated, a 2'-MOE sugar moiety is in the β-D-ribosyl configuration. "MOE" means O-methoxyethyl.

As used herein, "2'-MOE nucleoside" means a nucleoside comprising a 2'-MOE sugar moiety.

As used herein, "2'-OMe" means a 2'-OCH$_3$ group in place of the 2'—OH group of a furanosyl sugar moiety. A "2'-O-methyl sugar moiety" or "2'-OMe sugar moiety" means a sugar moiety with a 2'-OCH$_3$ group in place of the 2'-OH group of a furanosyl sugar moiety. Unless otherwise indicated, a 2'-OMe sugar moiety is in the β-D-ribosyl configuration.

As used herein, "2'-OMe nucleoside" means a nucleoside comprising a 2'-OMe sugar moiety.

As used herein, "2'-substituted nucleoside" means a nucleoside comprising a 2'-substituted sugar moiety. As used herein, "2'-substituted" in reference to a sugar moiety means a sugar moiety comprising at least one 2'-substituent group other than H or OH.

As used herein, "5-methyl cytosine" means a cytosine modified with a methyl group attached to the 5 position. A 5-methyl cytosine is a modified nucleobase.

As used herein, "administering" means providing a pharmaceutical agent to a subject.

As used herein, "antisense activity" means any detectable and/or measurable change attributable to the hybridization of an antisense compound to its target nucleic acid. In certain embodiments, antisense activity is a decrease in the amount or expression of a target nucleic acid or protein encoded by such target nucleic acid compared to target nucleic acid levels or target protein levels in the absence of the antisense compound.

As used herein, "antisense compound" means an oligomeric compound capable of achieving at least one antisense activity.

As used herein, "ameliorate" in reference to a treatment means improvement in at least one symptom relative to the same symptom in the absence of the treatment. In certain embodiments, amelioration is the reduction in the severity or frequency of a symptom or the delayed onset or slowing of progression in the severity or frequency of a symptom. In certain embodiments, the symptom or hallmark is gait and limb ataxia, cognitive impairments, difficulty with speaking and swallowing, atrophy of the cerebellum and brainstem in magnetic resonance imaging (MRI), neurochemical abnormalities in the cerebellum and brainstem detected via magnetic resonance spectroscopy (MRS), and death within 10-15 years of symptom onset.

As used herein, "bicyclic nucleoside" or "BNA" means a nucleoside comprising a bicyclic sugar moiety.

As used herein, "bicyclic sugar" or "bicyclic sugar moiety" means a modified sugar moiety comprising two rings, wherein the second ring is formed via a bridge connecting two of the atoms of the first ring thereby forming a bicyclic structure. In certain embodiments, the first ring of the bicyclic sugar moiety is a furanosyl moiety. In certain embodiments, the furanosyl sugar moiety is a ribosyl moiety. In certain embodiments, the bicyclic sugar moiety does not comprise a furanosyl moiety.

As used herein, "cleavable moiety" means a bond or group of atoms that is cleaved under physiological conditions, for example, inside a cell, an animal, or a human.

As used herein, "complementary" in reference to an oligonucleotide means that at least 70% of the nucleobases of the oligonucleotide or one or more portions thereof and the nucleobases of another nucleic acid or one or more portions thereof are capable of hydrogen bonding with one another when the nucleobase sequence of the oligonucleotide and the other nucleic acid are aligned in opposing directions. As used herein, complementary nucleobases means nucleobases that are capable of forming hydrogen bonds with one another. Complementary nucleobase pairs include adenine (A) and thymine (T), adenine (A) and uracil (U), cytosine (C) and guanine (G), 5-methyl cytosine (mC) and guanine (G). Complementary oligonucleotides and/or target nucleic acids need not have nucleobase complementarity at each nucleoside. Rather, some mismatches are tolerated. As used herein, "fully complementary" or "100% complementary" in reference to an oligonucleotide, or portion thereof, means that the oligonucleotide, or a portion thereof, is complementary to another oligonucleotide or target nucleic acid at each nucleobase of the shorter of the two oligonucleotides, or at each nucleoside if the oligonucleotides are the same length.

As used herein, "conjugate group" means a group of atoms that is directly or indirectly attached to an oligonucleotide. Conjugate groups include a conjugate moiety and a conjugate linker that attaches the conjugate moiety to the oligonucleotide.

As used herein, "conjugate linker" means a single bond or a group of atoms comprising at least one bond that connects a conjugate moiety to an oligonucleotide.

As used herein, "conjugate moiety" means a group of atoms that is attached to an oligonucleotide via a conjugate linker.

As used herein, "contiguous" in the context of an oligonucleotide refers to nucleosides, nucleobases, sugar moieties, or internucleoside linkages that are immediately adjacent to each other. For example, "contiguous nucleobases" means nucleobases that are immediately adjacent to each other in a sequence.

As used herein, "cEt" means a 4' to 2' bridge in place of the 2'OH-group of a ribosyl sugar moiety, wherein the bridge has the formula of 4'-CH(CH$_3$)—O-2', and wherein the methyl group of the bridge is in the S configuration. A "cEt sugar moiety" is a bicyclic sugar moiety with a 4' to 2' bridge in place of the 2'OH-group of a ribosyl sugar moiety, wherein the bridge has the formula of 4'-CH(CH$_3$)—O-2', and wherein the methyl group of the bridge is in the S configuration. "cEt" means constrained ethyl.

As used herein, "cEt nucleoside" means a nucleoside comprising a cEt sugar moiety. As used herein, "chirally enriched population" means a plurality of molecules of identical molecular formula, wherein the number or percentage of molecules within the population that contain a particular stereochemical configuration at a particular chiral center is greater than the number or percentage of molecules expected to contain the same particular stereochemical configuration at the same particular chiral center within the population if the particular chiral center were stereorandom. Chirally enriched populations of molecules having multiple chiral centers within each molecule may contain one or more stereorandom chiral centers. In certain embodiments, the molecules are modified oligonucleotides. In certain embodiments, the molecules are compounds comprising modified oligonucleotides.

As used herein, "chirally controlled" in reference to an internucleoside linkage means chirality at that linkage is enriched for a particular stereochemical configuration.

As used herein, "deoxy region" means a region of 5-12 contiguous nucleotides, wherein at least 70% of the nucleosides are 2'-β-D-deoxynucleosides. In certain embodiments, each nucleoside is selected from a 2'-β-D-deoxynucleoside, a bicyclic nucleoside, and a 2'-substituted nucleoside. In certain embodiments, a deoxy region supports RNase H activity. In certain embodiments, a deoxy region is the gap or internal region of a gapmer.

As used herein, "gapmer" means a modified oligonucleotide comprising an internal region having a plurality of nucleosides that support RNase H cleavage positioned between external regions having one or more nucleosides, wherein the nucleosides comprising the internal region are chemically distinct from the nucleoside or nucleosides comprising the external regions. The internal region may be referred to as the "gap" and the external regions may be referred to as the "wings." The internal region is a deoxy region. The positions of the internal region or gap refer to the order of the nucleosides of the internal region and are counted starting from the 5'-end of the internal region. Unless otherwise indicated, "gapmer" refers to a sugar motif. In certain embodiments, each nucleoside of the gap is a 2'-β-D-deoxynucleoside. In certain embodiments, the gap comprises one 2'-substituted nucleoside at position 1, 2, 3, 4, or 5 of the gap, and the remainder of the nucleosides of the gap are 2'-β-D-deoxynucleosides. As used herein, the term "MOE gapmer" indicates a gapmer having a gap comprising 2'-β-D-deoxynucleosides and wings comprising 2'-MOE nucleosides. As used herein, the term "mixed wing gapmer" indicates a gapmer having wings comprising modified nucleosides comprising at least two different sugar modifications. Unless otherwise indicated, a gapmer may comprise one or more modified internucleoside linkages and/or modified nucleobases and such modifications do not necessarily follow the gapmer pattern of the sugar modifications.

As used herein, "hotspot region" is a range of nucleobases on a target nucleic acid that is amenable to oligomeric compound-mediated reduction of the amount or activity of the target nucleic acid.

As used herein, "hybridization" means the pairing or annealing of complementary oligonucleotides and/or nucleic acids. While not limited to a particular mechanism, the most common mechanism of hybridization involves hydrogen bonding, which may be Watson-Crick, Hoogsteen or reversed Hoogsteen hydrogen bonding, between complementary nucleobases.

As used herein, "internucleoside linkage" means the covalent linkage between contiguous nucleosides in an oligonucleotide. As used herein, "modified internucleoside linkage" means any internucleoside linkage other than a phosphodiester internucleoside linkage. "Phosphorothioate internucleoside linkage" is a modified internucleoside linkage in which one of the non-bridging oxygen atoms of a phosphodiester internucleoside linkage is replaced with a sulfur atom.

As used herein, "linker-nucleoside" means a nucleoside that links, either directly or indirectly, an oligonucleotide to a conjugate moiety. Linker-nucleosides are located within the conjugate linker of an oligomeric compound. Linker-nucleosides are not considered part of the oligonucleotide portion of an oligomeric compound even if they are contiguous with the oligonucleotide.

As used herein, "non-bicyclic modified sugar moiety" means a modified sugar moiety that comprises a modification, such as a substituent, that does not form a bridge between two atoms of the sugar to form a second ring.

As used herein, "mismatch" or "non-complementary" means a nucleobase of a first oligonucleotide that is not complementary with the corresponding nucleobase of a second oligonucleotide or target nucleic acid when the first and second oligonucleotide are aligned.

As used herein, "motif" means the pattern of unmodified and/or modified sugar moieties, nucleobases, and/or internucleoside linkages, in an oligonucleotide.

As used herein, "nucleobase" means an unmodified nucleobase or a modified nucleobase. As used herein an "unmodified nucleobase" is adenine (A), thymine (T), cytosine (C), uracil (U), or guanine (G). As used herein, a "modified nucleobase" is a group of atoms other than unmodified A, T, C, U, or G capable of pairing with at least one unmodified nucleobase. A "5-methyl cytosine" is a modified nucleobase. A universal base is a modified nucleobase that can pair with any one of the five unmodified nucleobases. As used herein, "nucleobase sequence" means the order of contiguous nucleobases in a target nucleic acid or oligonucleotide independent of any sugar or internucleoside linkage modification.

As used herein, "nucleoside" means a compound or a fragment of a compound comprising a nucleobase and a sugar moiety. The nucleobase and sugar moiety are each, independently, unmodified or modified. As used herein, "modified nucleoside" means a nucleoside comprising a modified nucleobase and/or a modified sugar moiety. Modified nucleosides include abasic nucleosides, which lack a nucleobase. "Linked nucleosides" are nucleosides that are connected in a contiguous sequence (i.e., no additional nucleosides are presented between those that are linked).

As used herein, "oligomeric compound" means an oligonucleotide and optionally one or more additional features, such as a conjugate group or terminal group. An oligomeric compound may be paired with a second oligomeric compound that is complementary to the first oligomeric compound or may be unpaired. A "singled-stranded oligomeric compound" is an unpaired oligomeric compound. The term "oligomeric duplex" means a duplex formed by two oligomeric compounds having complementary nucleobase sequences. Each oligomeric compound of an oligomeric duplex may be referred to as a "duplexed oligomeric compound."

As used herein, "oligonucleotide" means a strand of linked nucleosides connected via internucleoside linkages, wherein each nucleoside and internucleoside linkage may be modified or unmodified. Unless otherwise indicated, oligonucleotides consist of 8-50 linked nucleosides. As used herein, "modified oligonucleotide" means an oligonucleotide, wherein at least one nucleoside or internucleoside linkage is modified. As used herein, "unmodified oligonucleotide" means an oligonucleotide that does not comprise any nucleoside modifications or internucleoside modifications.

As used herein, "pharmaceutically acceptable carrier or diluent" means any substance suitable for use in administering to a subject. Certain such carriers enable pharmaceutical compositions to be formulated as, for example, tablets, pills, dragees, capsules, liquids, gels, syrups, slurries, suspension and lozenges for the oral ingestion by a subject. In certain embodiments, a pharmaceutically acceptable carrier or diluent is sterile water, sterile saline, sterile buffer solution or sterile artificial cerebrospinal fluid.

As used herein, "pharmaceutically acceptable salts" means physiologically and pharmaceutically acceptable salts of compounds. Pharmaceutically acceptable salts retain the desired biological activity of the parent compound and do not impart undesired toxicological effects thereto.

As used herein, "pharmaceutical composition" means a mixture of substances suitable for administering to a subject. For example, a pharmaceutical composition may comprise an oligomeric compound and a sterile aqueous solution. In certain embodiments, a pharmaceutical composition shows activity in free uptake assay in certain cell lines.

As used herein, "prodrug" means a therapeutic agent in a form outside the body that is converted to a different form within a subject or cells thereof. Typically, conversion of a prodrug within the subject is facilitated by the action of an enzymes (e.g., endogenous or viral enzyme) or chemicals present in cells or tissues and/or by physiologic conditions.

As used herein, "reducing the amount or activity" refers to a reduction or blockade of the transcriptional expression or activity relative to the transcriptional expression or activity in an untreated or control sample and does not necessarily indicate a total elimination of transcriptional expression or activity.

As used herein, "RNA" means an RNA transcript and includes pre-mRNA and mature mRNA unless otherwise specified.

As used herein, "RNAi compound" means an antisense compound that acts, at least in part, through RISC or Ago2 to modulate a target nucleic acid and/or protein encoded by a target nucleic acid. RNAi compounds include, but are not limited to double-stranded siRNA, single-stranded RNA (ssRNA), and microRNA, including microRNA mimics. In certain embodiments, an RNAi compound modulates the amount, activity, and/or splicing of a target nucleic acid. The term RNAi compound excludes antisense compounds that act through RNase H.

As used herein, "self-complementary" in reference to an oligonucleotide means an oligonucleotide that at least partially hybridizes to itself.

As used herein, "standard in vitro assay" or "standard cell assay" means the assay described in Example 1 and reasonable variations thereof.

As used herein, "standard in vivo assay" means the assay described in Example 6 and reasonable variations thereof.

As used herein, "stereorandom chiral center" in the context of a population of molecules of identical molecular formula means a chiral center having a random stereochemical configuration. For example, in a population of molecules comprising a stereorandom chiral center, the number of molecules having the (S) configuration of the stereorandom chiral center may be but is not necessarily the same as the number of molecules having the (R) configuration of the stereorandom chiral center. The stereochemical configuration of a chiral center is considered random when it is the result of a synthetic method that is not designed to control the stereochemical configuration. In certain embodiments, a stereorandom chiral center is a stereorandom phosphorothioate internucleoside linkage.

As used herein, "subject" means a human or non-human animal.

As used herein, "sugar moiety" means an unmodified sugar moiety or a modified sugar moiety. As used herein, "unmodified sugar moiety" means a 2'-OH(H) β-D-ribosyl moiety, as found in RNA (an "unmodified RNA sugar moiety"), or a 2'-H(H) β-D-deoxyribosyl sugar moiety, as found in DNA (an "unmodified DNA sugar moiety"). Unmodified sugar moieties have one hydrogen at each of the 1', 3', and 4' positions, an oxygen at the 3' position, and two hydrogens at the 5' position. As used herein, "modified sugar moiety" or "modified sugar" means a modified furanosyl sugar moiety or a sugar surrogate.

As used herein, "sugar surrogate" means a modified sugar moiety having other than a furanosyl moiety that can link a nucleobase to another group, such as an internucleoside linkage, conjugate group, or terminal group in an oligonucleotide. Modified nucleosides comprising sugar surrogates can be incorporated into one or more positions within an oligonucleotide and such oligonucleotides are capable of hybridizing to complementary oligomeric compounds or target nucleic acids.

As used herein, "symptom or hallmark" means any physical feature or test result that indicates the existence or extent of a disease or disorder. In certain embodiments, a symptom is apparent to a subject or to a medical professional examining or testing said subject. In certain embodiments, a hallmark is apparent upon invasive diagnostic testing, including, but not limited to, post-mortem tests. In certain embodiments, a hallmark is apparent on a brain MRI scan.

As used herein, "target nucleic acid" and "target RNA" mean a nucleic acid that an antisense compound is designed to affect.

As used herein, "target region" means a portion of a target nucleic acid to which an oligomeric compound is designed to hybridize.

As used herein, "terminal group" means a chemical group or group of atoms that is covalently linked to a terminus of an oligonucleotide.

As used herein, "therapeutically effective amount" means an amount of a pharmaceutical agent that provides a therapeutic benefit to a subject. For example, a therapeutically effective amount improves a symptom or hallmark of a disease.

CERTAIN EMBODIMENTS

The present disclosure provides the following non-limiting numbered embodiments:

Embodiment 1. An oligomeric compound comprising a modified oligonucleotide consisting of 12 to 30 linked nucleosides wherein the nucleobase sequence of the modified oligonucleotide is at least 90% complementary to an equal length portion of an ATXN1 nucleic acid, and wherein the modified oligonucleotide comprises at least one modification selected from a modified sugar moiety and a modified internucleoside linkage.

Embodiment 2. An oligomeric compound comprising a modified oligonucleotide consisting of 12 to 30 linked nucleosides and having a nucleobase sequence comprising at least 12, 13, 14, 15, 16, 17, 18, 19, or 20 contiguous nucleobases of any of SEQ ID NOs: 22-3624 or 3655.

Embodiment 3. An oligomeric compound comprising a modified oligonucleotide consisting of 12 to 30 linked nucleosides and having a nucleobase sequence comprising at least 12, 13, 14, 15, 16, or 17 contiguous nucleobases of any of SEQ ID NOs: 3625-3654 or 3656-3669.

Embodiment 4. An oligomeric compound comprising a modified oligonucleotide consisting of 12 to 30 linked nucleosides and having a nucleobase sequence comprising at least 8, at least 9, at least 10, at least 11, at least 12, at least 13, at least 14, at least 15, at least 16, at least 17, at least 18, at least 19, or at least 20 contiguous nucleobases complementary to:

an equal length portion of nucleobases 5472-5552 of SEQ ID NO: 1;

an equal length portion of nucleobases 5906-6005 of SEQ ID NO: 1;

an equal length portion of nucleobases 7868-7911 of SEQ ID NO: 1;

an equal length portion of nucleobases 8481-8514 of SEQ ID NO: 1; or an equal length portion of nucleobases 446679-446706 of SEQ ID NO: 2.

Embodiment 5. An oligomeric compound comprising a modified oligonucleotide consisting of 12 to 30 linked nucleosides and having a nucleobase sequence comprising at least 8, at least 9, at least 10, at least 11, at least 12, at least 13, at least 14, at least 15, at least 16, or at least 17 contiguous nucleobases of a sequence selected from:

SEQ ID NOs: 196, 274, 352, 430, 508, 2578, 2655, 2732, 2809, 2886, 2963, 3121, 3122, 3190, 3191, 3192, 3262, 3330, 3331, 3332, 3401, 3402, 3575, 3577, 3620, 3624, 3638-3640, 3653-3655, 3662, 3665, 3669;

SEQ ID Nos: 42, 120, 198, 276, 509, 587, 2502, 2579, 2656, 2733, 2810, 2887, 2964, 3585, 3588-3590, 3615, 3618, 3622, 3657, 3660, 3661, 3663, 3664, 3666-3668;

SEQ ID Nos: 48, 126, 2044, 2121;

SEQ ID Nos: 128, 206, 284, 1045, 1122, 1199, and 1276; or

SEQ ID Nos: 2475, 2552, 2629, 2706, 2783, 3627-3630, 3644.

Embodiment 6. The oligomeric compound of any of embodiments 1-5, wherein the modified oligonucleotide has a nucleobase sequence that is at least 80%, 85%, 90%, 95%, or 100% complementary to the nucleobase sequence of SEQ ID NO: 1, SEQ ID NO: 2, SEQ ID NO: 3, SEQ ID NO: 4, SEQ ID NO: 5, or SEQ ID NO: 6 when measured across the entire nucleobase sequence of the modified oligonucleotide.

Embodiment 7. The oligomeric compound of any of embodiments 1-6, wherein the modified oligonucleotide comprises at least one modified nucleoside.

Embodiment 8. The oligomeric compound of embodiment 7, wherein the modified oligonucleotide comprises at least one modified nucleoside comprising a modified sugar moiety.

Embodiment 9. The oligomeric compound of embodiment 8, wherein the modified oligonucleotide comprises at least one modified nucleoside comprising a bicyclic sugar moiety.

Embodiment 10. The oligomeric compound of embodiment 9, wherein the modified oligonucleotide comprises at least one modified nucleoside comprising a bicyclic sugar moiety having a 2'-4' bridge, wherein the 2'-4' bridge is selected from —O—CH$_2$—; and —O—CH(CH$_3$)—.

Embodiment 11. The oligomeric compound of any of embodiments 7-10, wherein the modified oligonucleotide comprises at least one modified nucleoside comprising a non-bicyclic modified sugar moiety.

Embodiment 12. The oligomeric compound of embodiment 11, wherein the non-bicyclic modified sugar moiety is a 2'-MOE sugar moiety or 2'-OMe modified sugar moiety.

Embodiment 13. The oligomeric compound of any of embodiments 7-8, wherein the modified oligonucleotide comprises at least one modified nucleoside comprising a sugar surrogate.

Embodiment 14. The oligomeric compound of embodiment 13, wherein the modified oligonucleotide comprises at least one modified nucleoside comprising a sugar surrogate selected from morpholino and PNA.

Embodiment 15. The oligomeric compound of any of embodiments 1-8 or 11-14, wherein the modified oligonucleotide does not comprise a bicyclic sugar moiety.

Embodiment 16. The oligomeric compound of any of embodiments 1-15, wherein the modified oligonucleotide is a gapmer.

Embodiment 17. The oligomeric compound of any of embodiments 1-16, wherein the modified oligonucleotide has a sugar motif comprising:

a 5'-region consisting of 1-6 linked 5'-region nucleosides;

a central region consisting of 6-10 linked central region nucleosides; and a 3'-region consisting of 1-6 linked 3'-region nucleosides; wherein each of the 5'-region nucleosides and each of the 3'-region nucleosides comprises a modified sugar moiety and each of the central region nucleosides comprises a 2'-deoxyfuranosyl sugar moiety.

Embodiment 18. The oligomeric compound of embodiment 17, wherein the modified oligonucleotide has a sugar motif comprising:

a 5'-region consisting of 6 linked 5'-region nucleosides;

a central region consisting of 10 linked central region nucleosides; and a 3'-region consisting of 4 linked 3'-region nucleosides; wherein each of the 5'-region nucleosides and each of the 3'-region nucleosides is a 2'-MOE nucleoside, and each of the central region nucleosides is a 2'-β-D-deoxynucleoside.

Embodiment 19. The oligomeric compound of embodiment 17, wherein the modified oligonucleotide has a sugar motif comprising:

a 5'-region consisting of 5 linked 5'-region nucleosides;

a central region consisting of 10 linked central region nucleosides; and a 3'-region consisting of 5 linked 3'-region nucleosides; wherein each of the 5'-region nucleosides and each of the 3'-region nucleosides is a 2'-MOE nucleoside, and each of the central region nucleosides is a 2'-β-D-deoxynucleoside.

Embodiment 20. The oligomeric compound of embodiment 17, wherein the modified oligonucleotide has a 5'-region consisting of 5 linked 5'-region nucleosides;

a central region consisting of 8 linked central region nucleosides; and a 3'-region consisting of 4 linked 3'-region nucleosides; wherein each of the 5'-region nucleosides and each of the 3'-region nucleosides comprises a is a 2'-MOE nucleoside, and each of the central region nucleosides is a 2'-β-D-deoxynucleoside.

Embodiment 21. The oligomeric compound of embodiment 17, wherein the modified oligonucleotide has
a 5'-region consisting of 5 linked 5'-region nucleosides;
a central region consisting of 8 linked central region nucleosides; and
a 3'-region consisting of 4 linked 3'-region nucleosides; wherein
each of the 5'-region nucleosides comprises a 2'-MOE sugar moiety, each of the 3'-region nucleosides is selected from a 2'-MOE nucleoside and a cEt nucleoside, and each of the central region nucleosides comprises a 2'-β-D-deoxynucleoside.

Embodiment 22. The oligomeric compound of any of embodiments 1-16, wherein the modified oligonucleotide has a sugar motif comprising:
a 5'-region consisting of 1-6 linked 5'-region nucleosides;
a central region consisting of 6-10 linked central region nucleosides; and
a 3'-region consisting of 1-6 linked 3'-region nucleosides; wherein
each of the 5'-region nucleosides and each of the 3'-region nucleosides comprises a modified sugar moiety,
and the central region has the following formula:
(Nd)(Nx)(Nd)n
wherein Nx is a 2'-OMe nucleoside and each Nd is a 2'-β-D-deoxynucleoside; and n is from 6 to 8.

Embodiment 23. The oligomeric compound of any of embodiments 1-16, wherein the modified oligonucleotide has a sugar motif comprising:
a 5'-region consisting of 5 linked 5'-region nucleosides;
a central region consisting of 6-10 linked central region nucleosides; and
a 3'-region consisting of 4 linked 3'-region nucleosides; wherein
each of the 5'-region nucleosides and each of the 3'-region nucleosides is selected from a 2'-MOE nucleoside and a cEt nucleoside,
and the central region has the following formula:
(Nd)(Nx)(Nd)n
wherein Nx is a 2'-OMe nucleoside and each Nd is a 2'-β-D-deoxynucleoside; and n is 7.

Embodiment 24. The oligomeric compound of any of embodiments 1-23, wherein the modified oligonucleotide comprises at least one modified internucleoside linkage.

Embodiment 25. The oligomeric compound of embodiment 24, wherein each internucleoside linkage of the modified oligonucleotide is a modified internucleoside linkage.

Embodiment 26. The oligomeric compound of embodiment 24 or 25 wherein the modified internucleoside linkage is a phosphorothioate internucleoside linkage.

Embodiment 27. The oligomeric compound of embodiment 24 or 26 wherein the modified oligonucleotide comprises at least one phosphodiester internucleoside linkage.

Embodiment 28. The oligomeric compound of any of embodiments 24, 26, or 27 wherein each internucleoside linkage is independently selected from a phosphodiester internucleoside linkage or a phosphorothioate internucleoside linkage.

Embodiment 29. The oligomeric compound of embodiments 1-24 or 26-28, wherein the modified oligonucleotide has an internucleoside linkage motif selected from among: sooossssssssssssooss, sssossssssssssssosss, sssosssssssssssoss, or sooooosssssssssssoss; wherein, s=a phosphorothioate internucleoside linkage and o=a phosphodiester internucleoside linkage.

Embodiment 30. The oligomeric compound of any of embodiments 1-29, wherein the modified oligonucleotide comprises a modified nucleobase.

Embodiment 31. The oligomeric compound of embodiment 30, wherein the modified nucleobase is a 5-methyl cytosine.

Embodiment 32. The oligomeric compound of any of embodiments 1-31, wherein the modified oligonucleotide consists of 12-30, 12-22, 12-20, 14-18, 16-18, 14-20, 15-17, 15-25, 16-20, or 17-20 linked nucleosides.

Embodiment 33. The oligomeric compound of any of embodiments 1-2, 4-19, 22 or 24-31, wherein the modified oligonucleotide consists of 18-22 or 18-20 linked nucleosides.

Embodiment 34. The oligomeric compound of any of embodiments 1-17 or 20-32, wherein the modified oligonucleotide consists of 17 linked nucleosides.

Embodiment 35. The oligomeric compound of any of embodiments 1-2, 4-19, 22 or 24-31, wherein the modified oligonucleotide consists of 20 linked nucleosides.

Embodiment 36. The oligomeric compound of any of embodiments 1-35, consisting of the modified oligonucleotide.

Embodiment 37. The oligomeric compound of any of embodiments 1-35, comprising a conjugate group comprising a conjugate moiety and a conjugate linker.

Embodiment 38. The oligomeric compound of embodiment 37, wherein the conjugate linker consists of a single bond.

Embodiment 39. The oligomeric compound of embodiment 37, wherein the conjugate linker is cleavable.

Embodiment 40. The oligomeric compound of embodiment 37, wherein the conjugate linker comprises 1-3 linker-nucleosides.

Embodiment 41. The oligomeric compound of any of embodiments 37-40, wherein the conjugate group is attached to the modified oligonucleotide at the 5'-end of the modified oligonucleotide.

Embodiment 42. The oligomeric compound of any of embodiments 37-40, wherein the conjugate group is attached to the modified oligonucleotide at the 3'-end of the modified oligonucleotide.

Embodiment 43. The oligomeric compound of any of embodiments 1-35 or 37-42, comprising a terminal group.

Embodiment 44. The oligomeric compound of any of embodiments 1-43 wherein the oligomeric compound is a singled-stranded oligomeric compound.

Embodiment 45. The oligomeric compound of any of embodiments 1-39 or 41-42, wherein the oligomeric compound does not comprise linker-nucleosides.

Embodiment 46. An oligomeric duplex comprising an oligomeric compound of any of embodiments 1-43 or 45.

Embodiment 47. An antisense compound comprising or consisting of an oligomeric compound of any of embodiments 1-45 or an oligomeric duplex of embodiment 46.

Embodiment 48. A pharmaceutical composition comprising an oligomeric compound of any of embodiments 1-45 or an oligomeric duplex of embodiment 46 and a pharmaceutically acceptable carrier or diluent.

Embodiment 49. The pharmaceutical composition of embodiment 48, wherein the pharmaceutically acceptable diluent is artificial cerebral spinal fluid.

Embodiment 50. The pharmaceutical composition of embodiment 49, wherein the pharmaceutical composition consists essentially of the modified oligonucleotide and artificial cerebral spinal fluid.

Embodiment 51. A method comprising administering to a subject a pharmaceutical composition of any of embodiments 48-50.

Embodiment 52. A method of treating a disease associated with ATXN1 comprising administering to an individual having or at risk for developing a disease associated with ATXN1 a therapeutically effective amount of a pharmaceutical composition according to any of embodiments 48-50; and thereby treating the disease associated with ATXN1.

Embodiment 53. The method of embodiment 52, wherein the ATXN1-associated disease is Spinocerebellar ataxia type 1.

Embodiment 54. The method of any of embodiments 51-52, wherein at least one symptom or hallmark of the ATXN1-associated disease is ameliorated.

Embodiment 55. The method of embodiment 54, wherein the symptom or hallmark is gait or limb ataxia, cognitive impairments, difficulty with speaking or swallowing, atrophy of the cerebellum and/or brainstem in magnetic resonance imaging (MRI), neurochemical abnormalities in the cerebellum and/or brainstem detected via magnetic resonance spectroscopy (MRS), or death within 10-15 years of symptom onset.

Embodiment 56. The method of any of embodiments 51-53, wherein ATXN1 levels in the individual are reduced.

Embodiment 57. A modified oligonucleotide according to the following chemical structure:

(SEQ ID NO: 126)

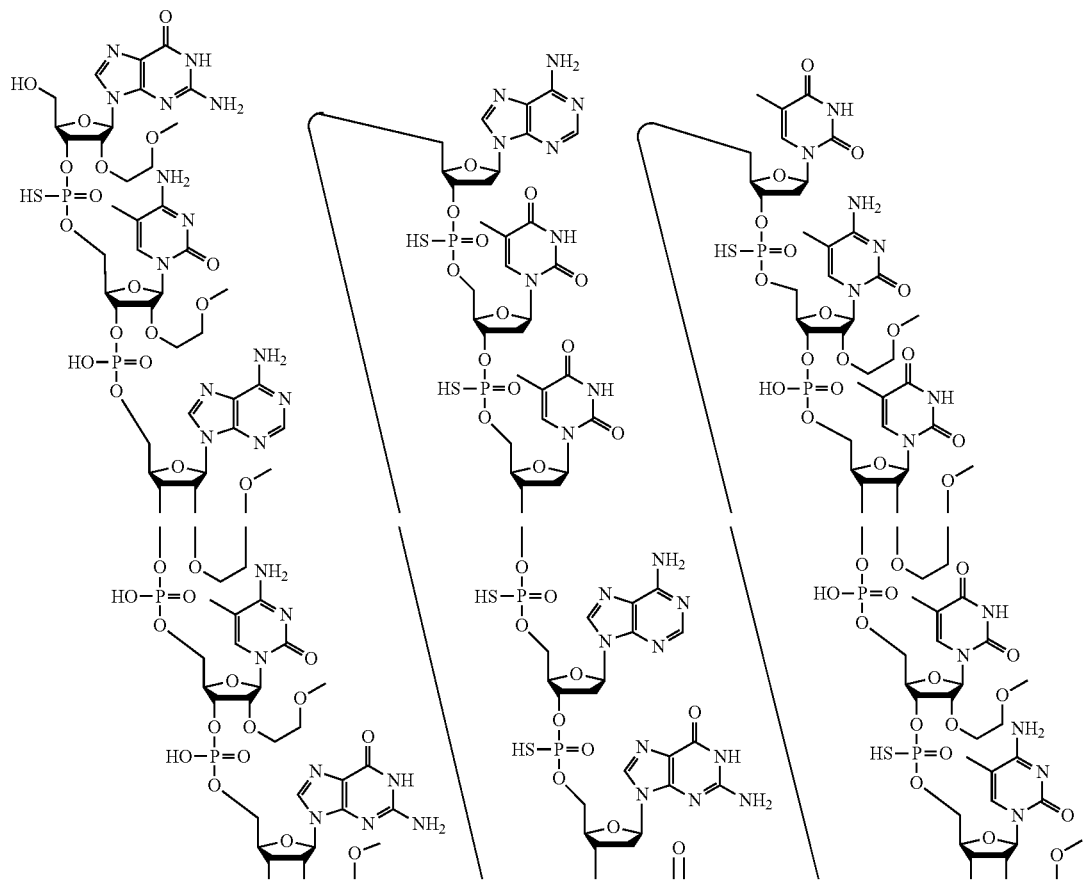

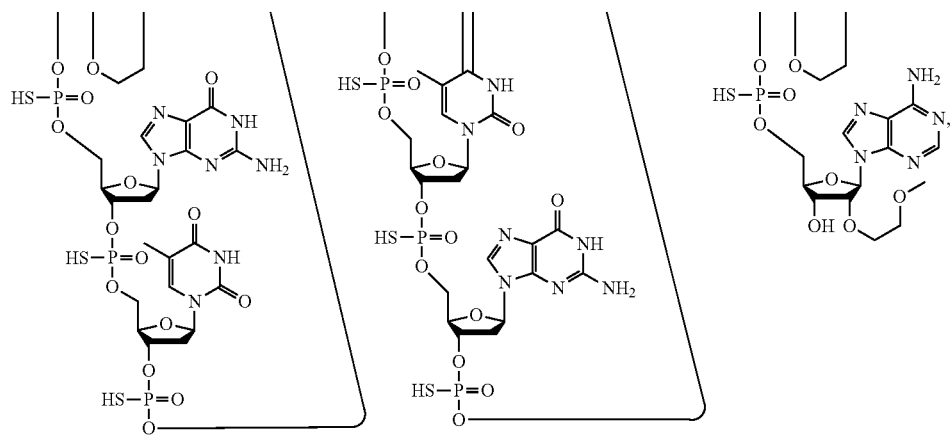
or a salt thereof.
Embodiment 58. A modified oligonucleotide according to the following chemical structure:
(SEQ ID NO: 1045)
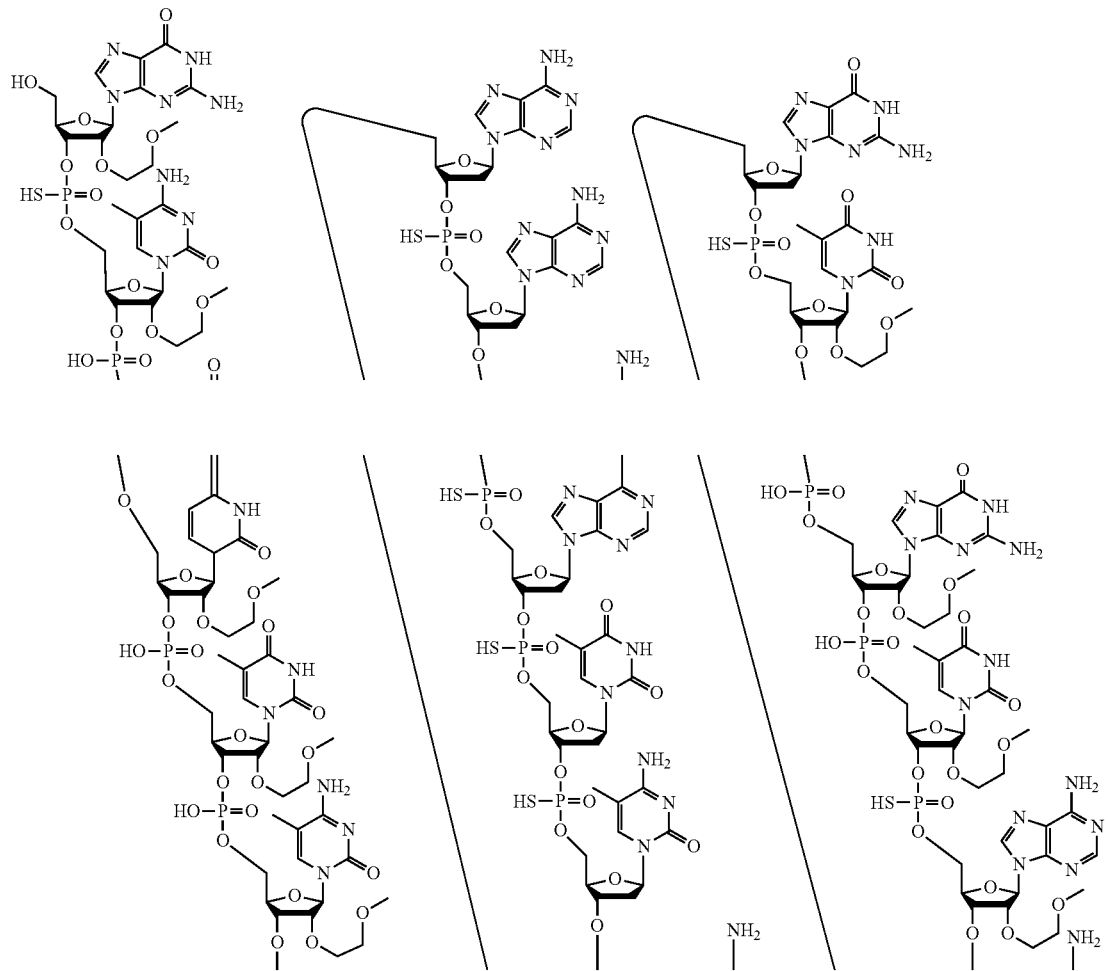

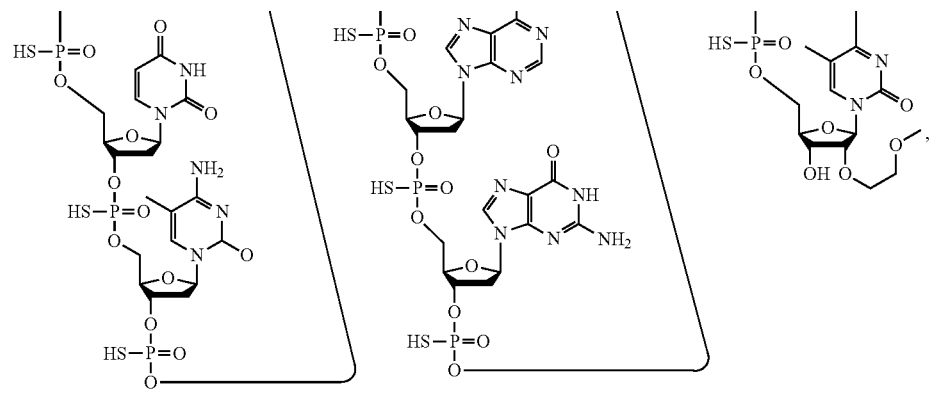
or a salt thereof.
Embodiment 59. A modified oligonucleotide according to the following chemical structure:
(SEQ ID NO: 2552)
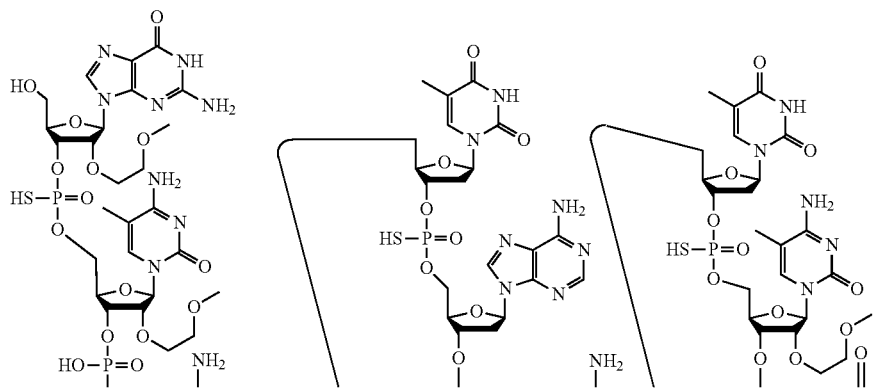
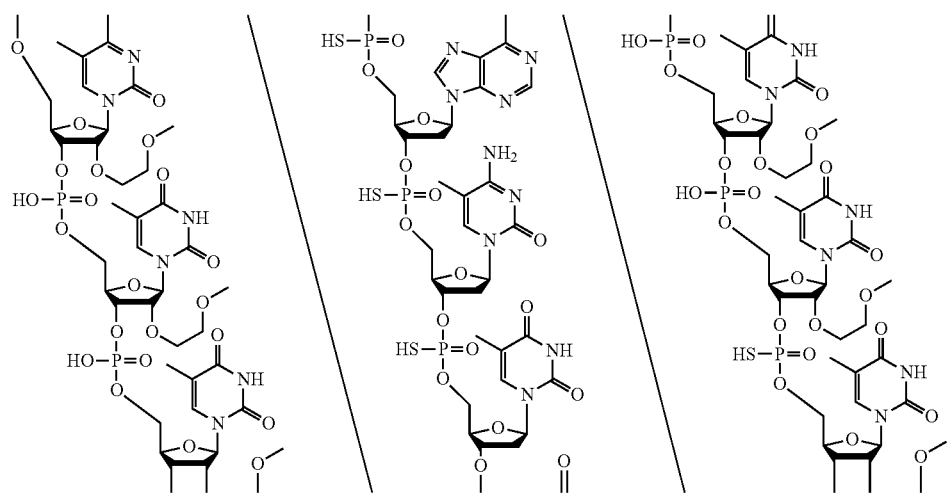

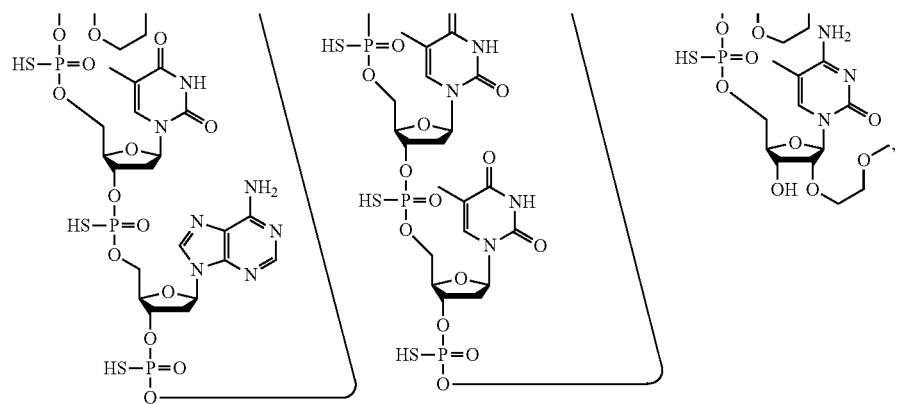
or a salt thereof.
Embodiment 60. A modified oligonucleotide according to the following chemical structure:
(SEQ ID NO: 3190)
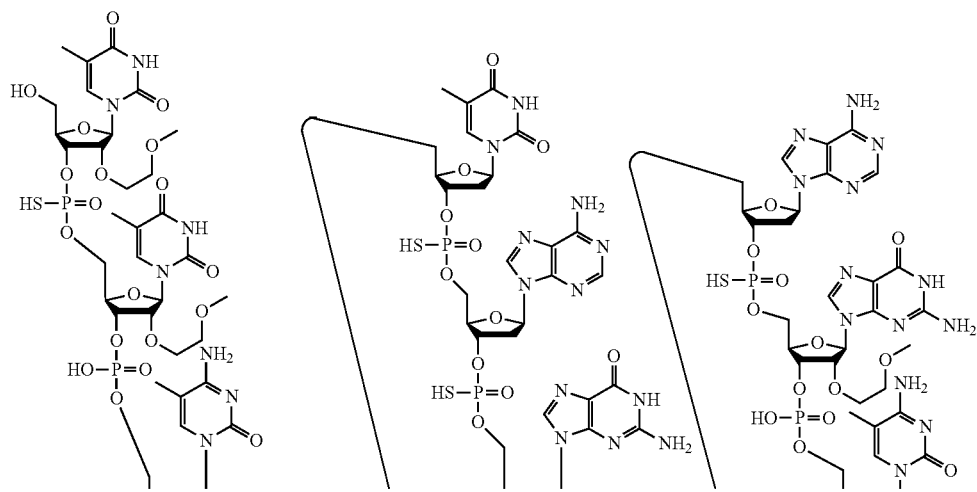
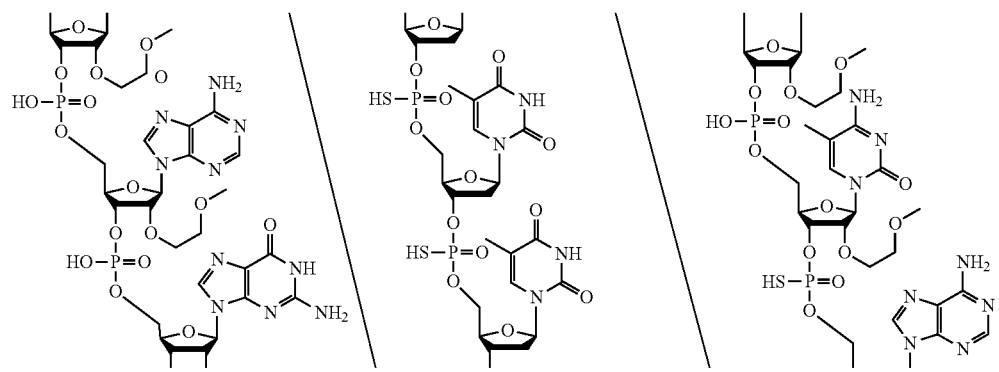

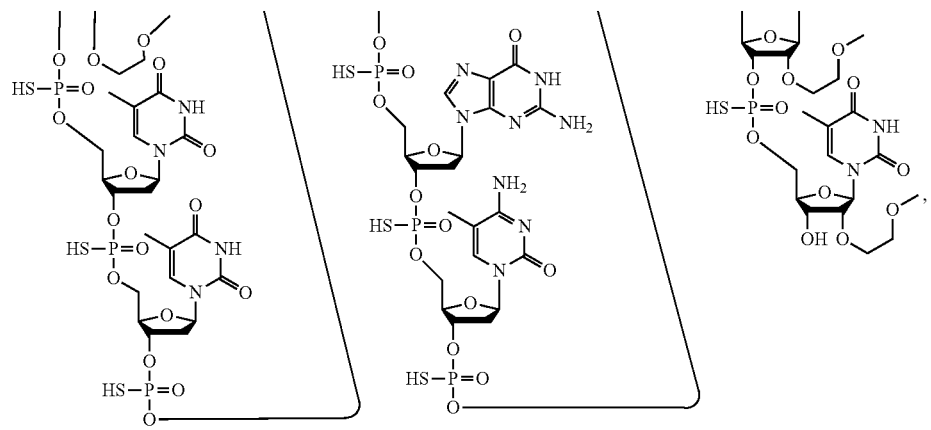
or a salt thereof.
Embodiment 61. A modified oligonucleotide according to the following chemical structure:
(SEQ ID NO: 3590)
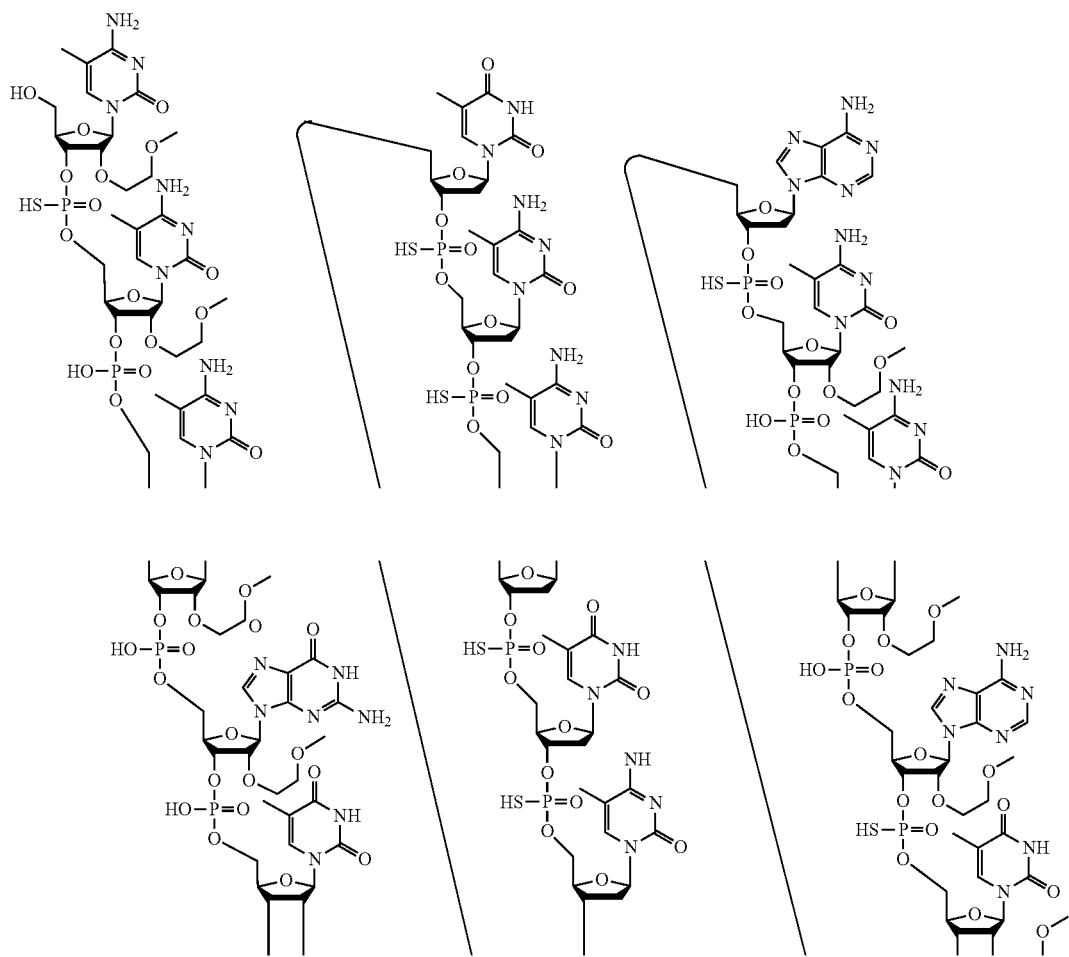

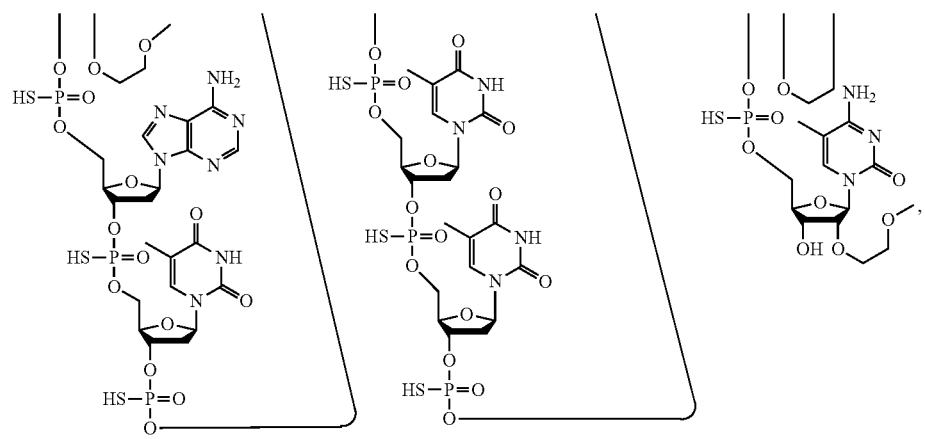
or a salt thereof.
Embodiment 62. A modified oligonucleotide according to the following chemical structure:
(SEQ ID NO: 3638)
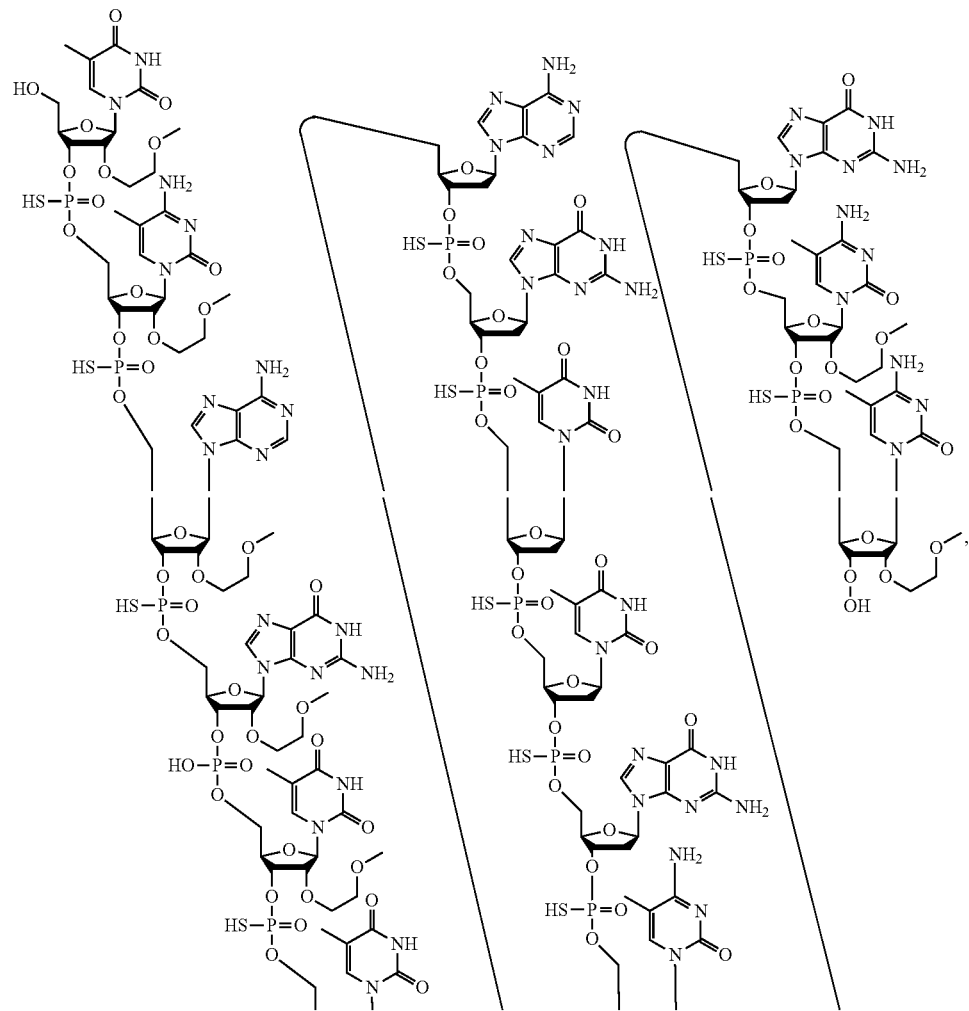

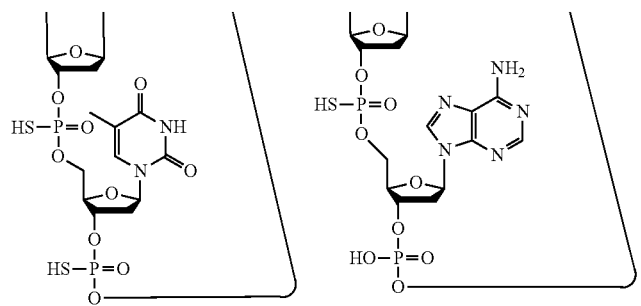
or a salt thereof.
Embodiment 63. A modified oligonucleotide according to the following chemical structure:
(SEQ ID NO: 126)
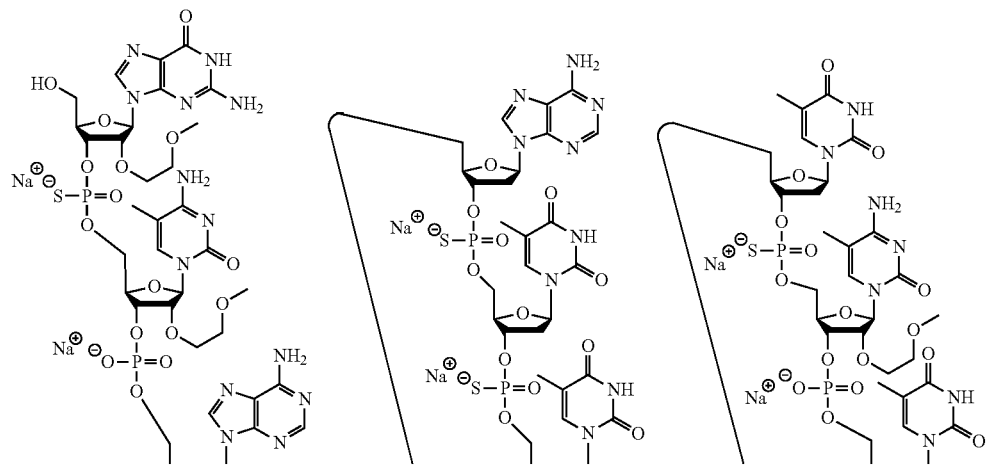
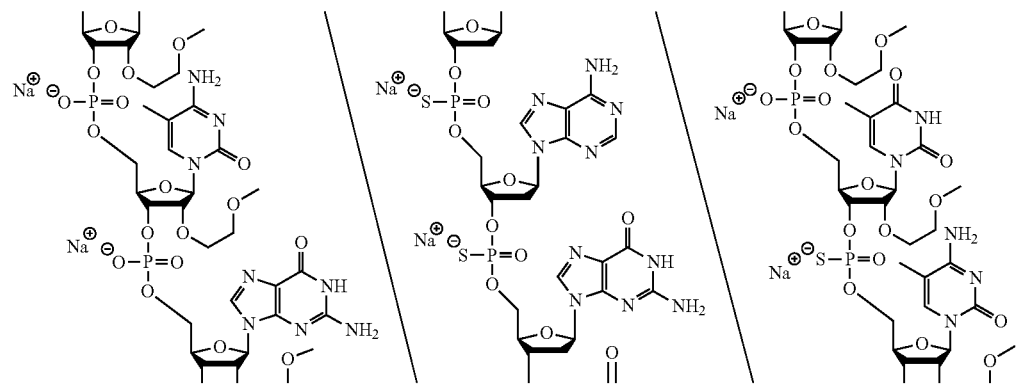

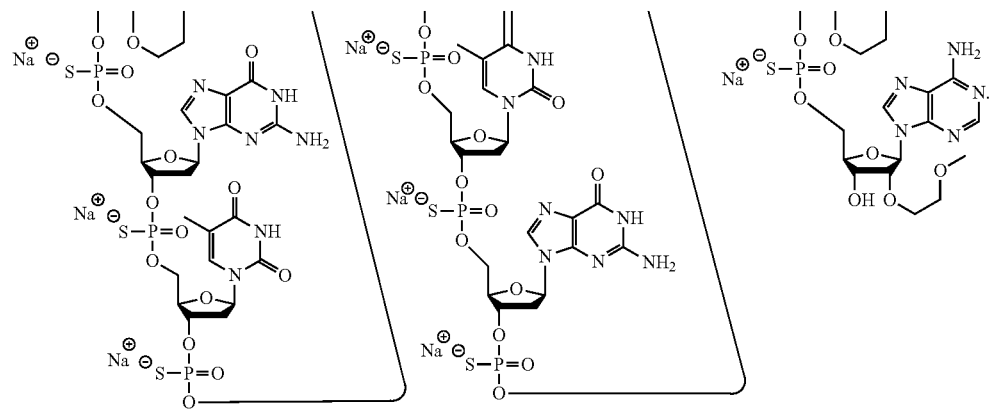
Embodiment 64. A modified oligonucleotide according to the following chemical structure:
(SEQ ID NO: 1045)
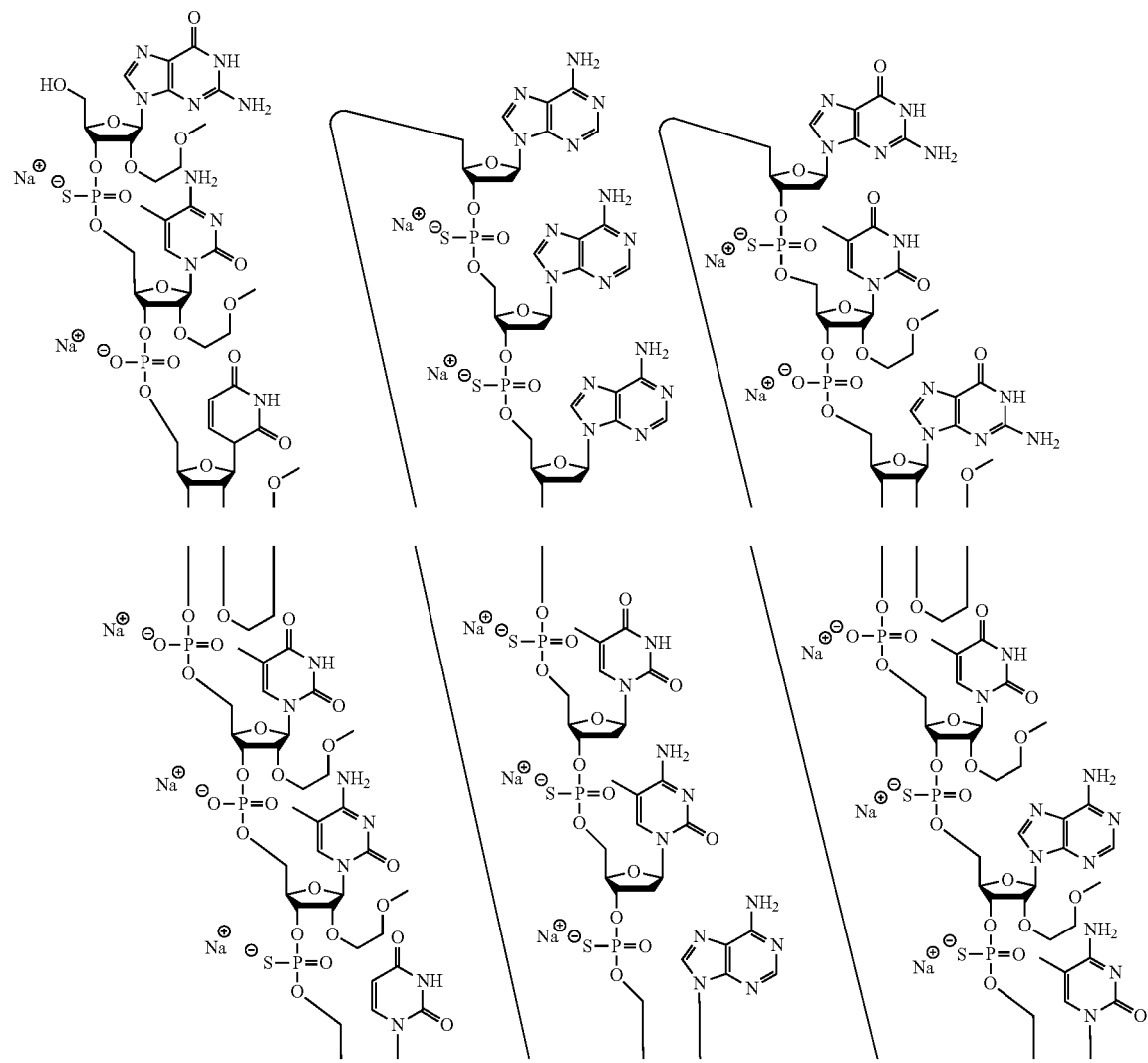

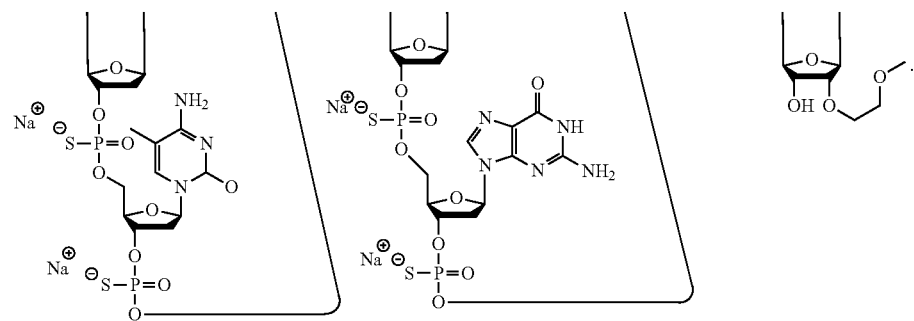
Embodiment 65. A modified oligonucleotide according to the following chemical structure:
(SEQ ID NO: 2552)
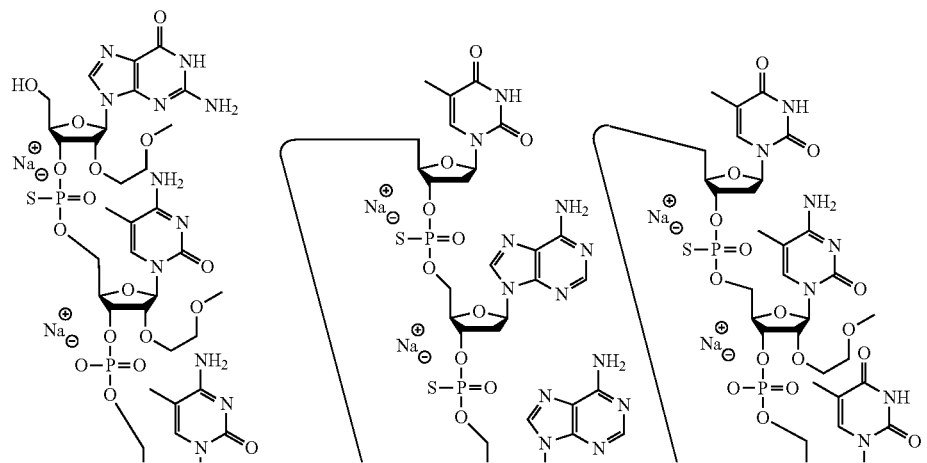
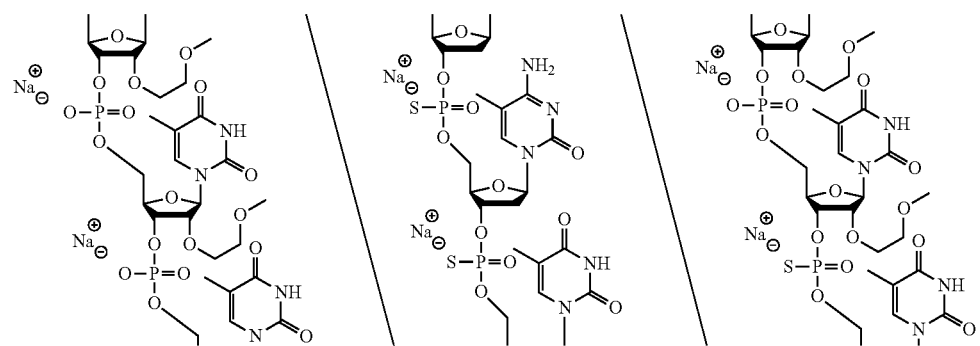

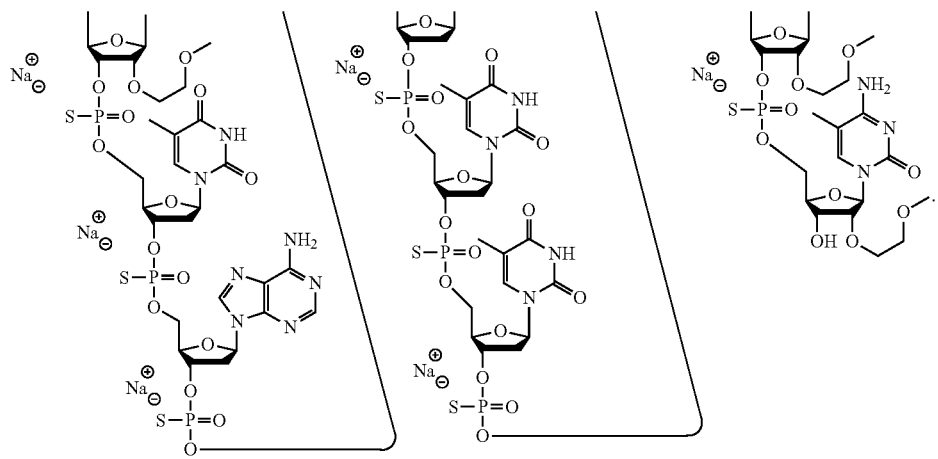
Embodiment 66. A modified oligonucleotide according to the following chemical structure:
(SEQ ID NO: 3190)
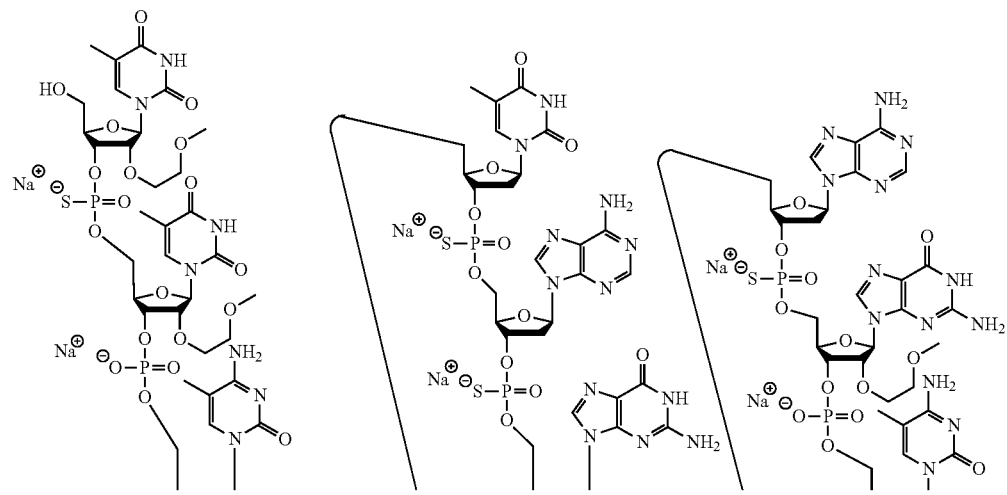
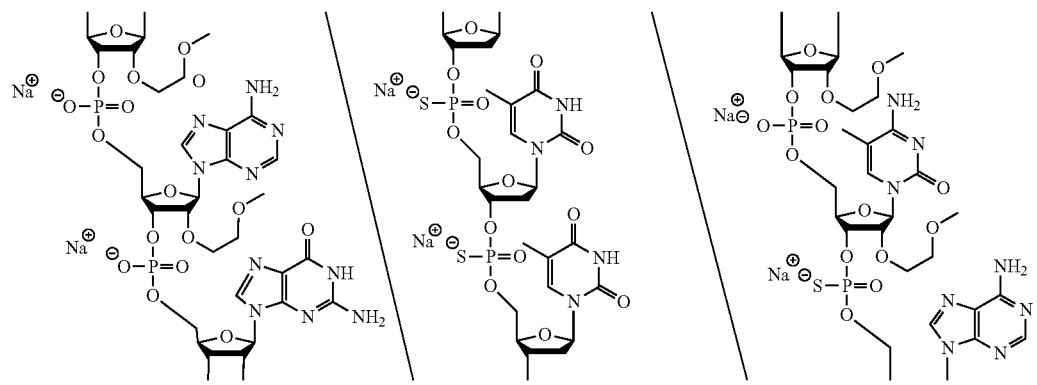

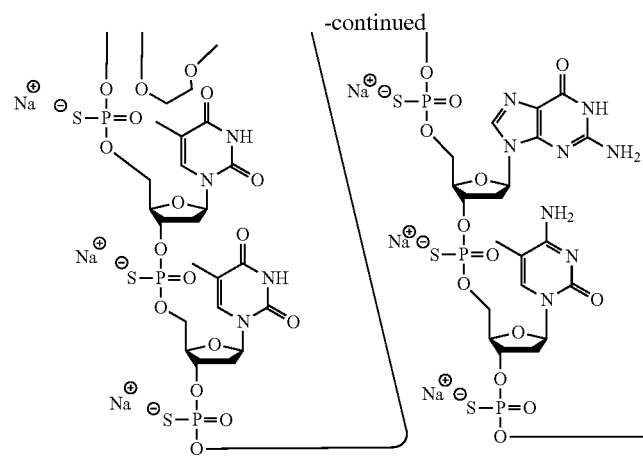
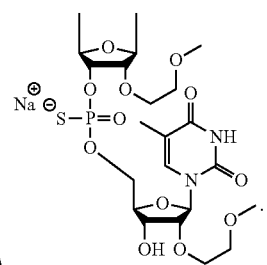
Embodiment 67. A modified oligonucleotide according to the following chemical structure:
(SEQ ID NO: 3590)
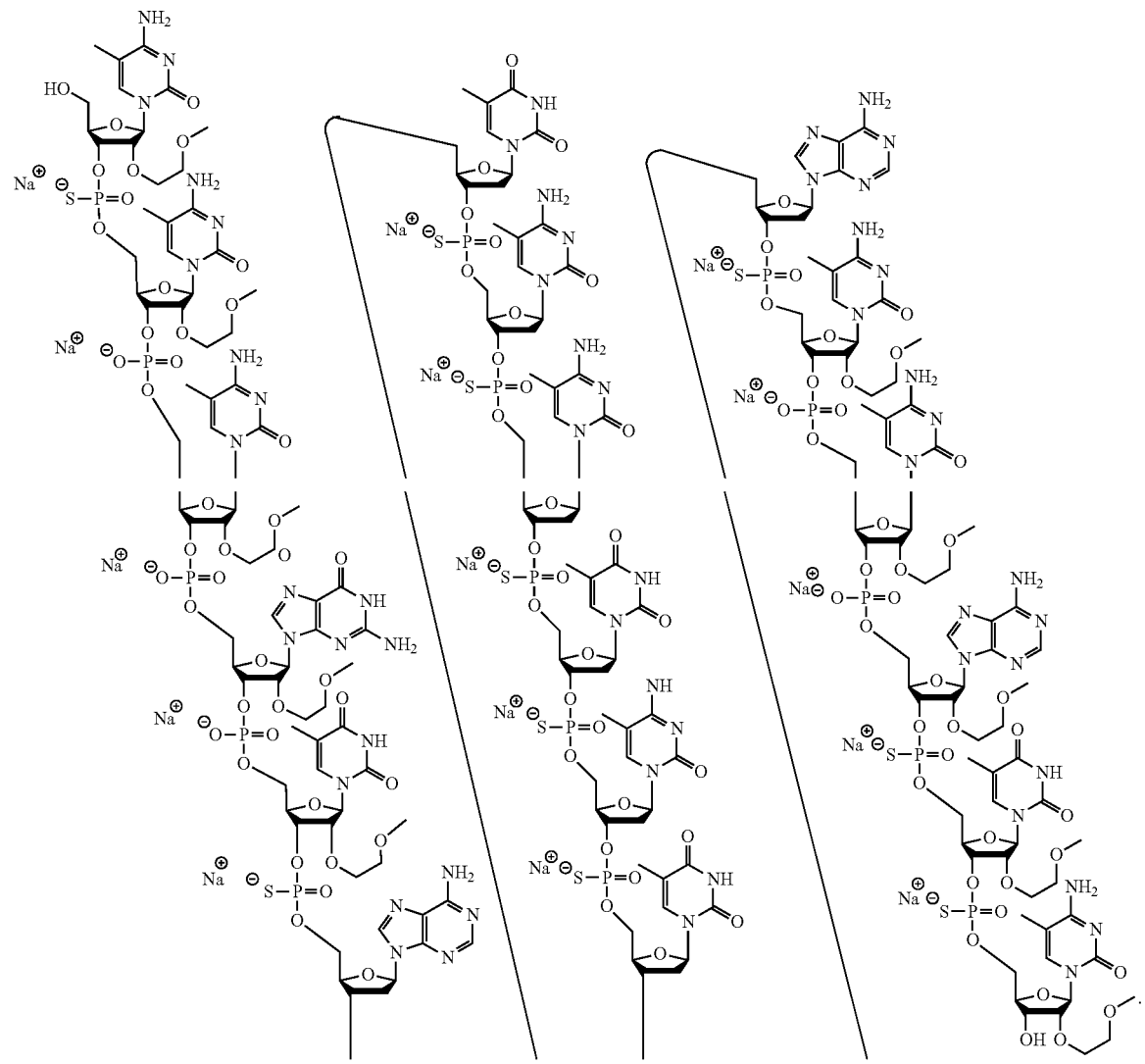

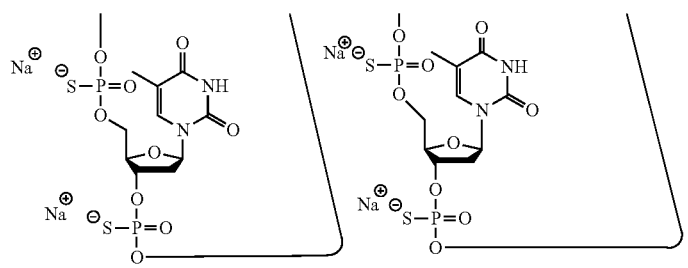
Embodiment 68. A modified oligonucleotide according to the following chemical structure:
(SEQ ID NO: 3638)
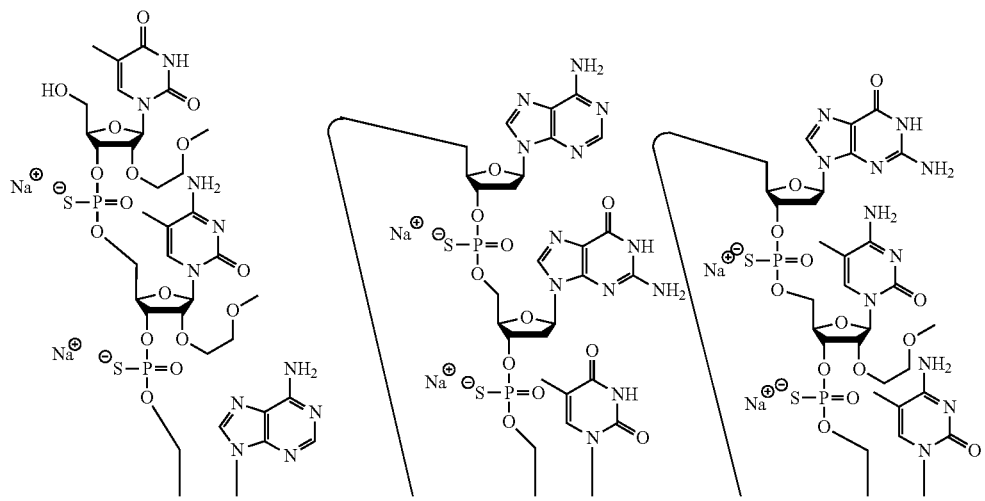
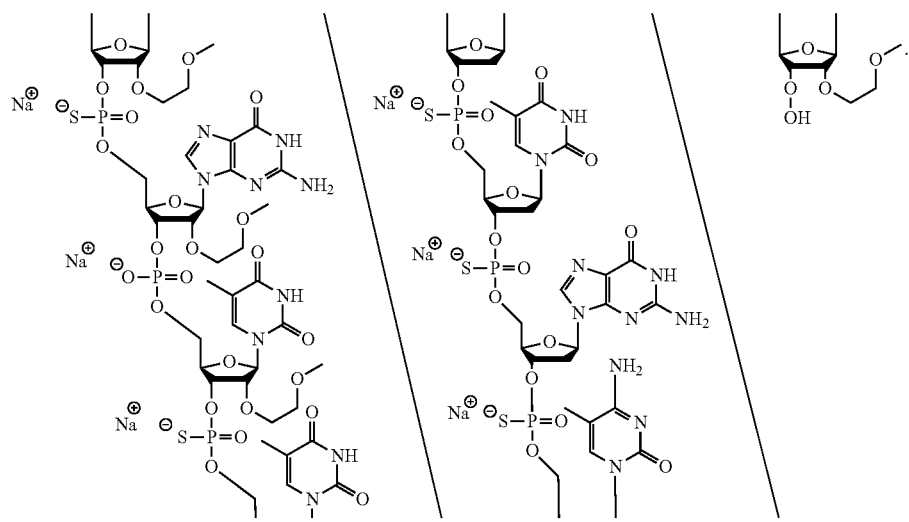

-continued

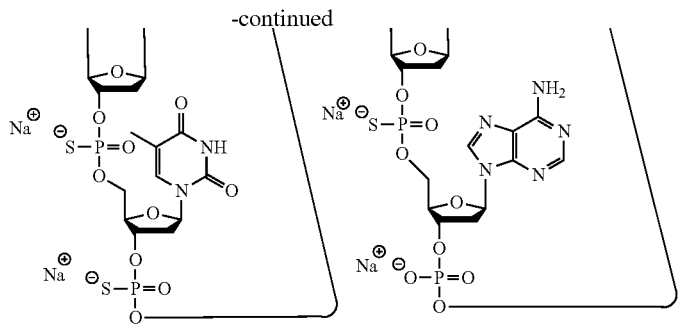

Embodiment 69. The modified oligonucleotide of embodiment 57-62, which is a sodium salt or a potassium salt.

Embodiment 70. A compound comprising a modified oligonucleotide according to the following chemical notation:
Ges $^m$Ceo Aeo $^m$Ceo Ges Gds Tds Ads Tds Tds Ads Gds Tds Gds Tds $^m$Ceo Teo Tes $^m$Ces Ae (SEQ ID NO: 126), wherein,
A=an adenine nucleobase,
$^m$C=a 5-methyl cytosine nucleobase,
G=a guanine nucleobase,
T=a thymine nucleobase,
e=a 2'-MOE sugar moiety,
d=a 2'-β-D deoxyribosyl sugar moiety,
s=a phosphorothioate internucleoside linkage, and
o=a phosphodiester internucleoside linkage.

Embodiment 71. A compound comprising a modified oligonucleotide according to the following chemical notation:
Ges $^m$Ceo Teo Teo $^m$Ces Tds $^m$Cds Ads Ads Ads Tds $^m$Cds Ads Gds Gds Teo Geo Tes Aes $^m$Ce (SEQ ID NO: 1045), wherein,
A=an adenine nucleobase,
$^m$C=a 5-methyl cytosine nucleobase,
G=a guanine nucleobase,
T=a thymine nucleobase,
e=a 2'-MOE sugar moiety,
d=a 2'-β-D deoxyribosyl sugar moiety,
s=a phosphorothioate internucleoside linkage, and
o=a phosphodiester internucleoside linkage.

Embodiment 72. A compound comprising a modified oligonucleotide according to the following chemical notation:
Ges $^m$Ceo $^m$Ceo Teo Tes Tds Ads Tds Ads Ads $^m$Cds Tds Tds Tds Tds $^m$Ceo Teo Tes Tes $^m$Ce (SEQ ID NO: 2552), wherein,
A=an adenine nucleobase,
$^m$C=a 5-methyl cytosine nucleobase,
G=a guanine nucleobase,
T=a thymine nucleobase,
e=a 2'-MOE sugar moiety,
d=a 2'-β-D deoxyribosyl sugar moiety,
s=a phosphorothioate internucleoside linkage, and
o=a phosphodiester internucleoside linkage.

Embodiment 73. A compound comprising a modified oligonucleotide according to the following chemical notation:
Tes Teo $^m$Ceo Aeo Ges Tds Tds Tds Ads Gds Tds Tds Gds $^m$Cds Ads Geo $^m$Ceo $^m$Ces Aes Te (SEQ ID NO: 3190), wherein,
A=an adenine nucleobase,
$^m$C=a 5-methyl cytosine nucleobase,
G=a guanine nucleobase,
T=a thymine nucleobase,
e=a 2'-MOE sugar moiety,
d=a 2'-β-D deoxyribosyl sugar moiety,
s=a phosphorothioate internucleoside linkage, and
o=a phosphodiester internucleoside linkage.

Embodiment 74. A compound comprising a modified oligonucleotide according to the following chemical notation:
$^m$Ces $^m$Ceo $^m$Ceo Geo Tes Ads Tds Tds $^m$Cds $^m$Cds Tds $^m$Cds Tds Tds Ads $^m$Ceo $^m$Ceo Aes Tes $^m$Ce (SEQ ID NO: 3590), wherein,
A=an adenine nucleobase,
$^m$C=a 5-methyl cytosine nucleobase,
G=a guanine nucleobase,
T=a thymine nucleobase,
e=a 2'-MOE sugar moiety,
d=a 2'-β-D deoxyribosyl sugar moiety,
s=a phosphorothioate internucleoside linkage, and
o=a phosphodiester internucleoside linkage.

Embodiment 75. A compound comprising a modified oligonucleotide according to the following chemical notation:
Tes $^m$Ces Aes Geo Tes Tds Tds Ads Gds Tds Tds Gds $^m$Cds Aeo Ges $^m$Ces $^m$Ce (SEQ ID NO: 3638), wherein,
A=an adenine nucleobase,
$^m$C=a 5-methyl cytosine nucleobase,
G=a guanine nucleobase,
T=a thymine nucleobase,
e=a 2'-MOE sugar moiety,
d=a 2'-β-D deoxyribosyl sugar moiety,
s=a phosphorothioate internucleoside linkage, and
o=a phosphodiester internucleoside linkage.

Embodiment 76. The compound of any of embodiments 73-78, comprising the modified oligonucleotide covalently linked to a conjugate group.

Embodiment 77. A chirally enriched population of modified oligonucleotides of any of embodiments 57-68, wherein the population is enriched for modified oligonucleotides comprising at least one particular phosphorothioate internucleoside linkage having a particular stereochemical configuration.

Embodiment 78. The chirally enriched population of embodiment 77, wherein the population is enriched for modified oligonucleotides comprising at least one particular phosphorothioate internucleoside linkage having the (Sp) or (Rp) configuration.

Embodiment 79. The chirally enriched population of embodiment 77, wherein the population is enriched for modified oligonucleotides having a particular, independently selected stereochemical configuration at each phosphorothioate internucleoside linkage.

Embodiment 80. The chirally enriched population of embodiment 77, wherein the population is enriched for modified oligonucleotides having the (Rp) configuration at one particular phosphorothioate internucleoside linkage and the (Sp) configuration at each of the remaining phosphorothioate internucleoside linkages.

Embodiment 81. The chirally enriched population of embodiment 77 wherein the population is enriched for modified oligonucleotides having at least 3 contiguous phosphorothioate internucleoside linkages in the Sp, Sp, and Rp configurations, in the 5' to 3' direction.

Embodiment 82. A population of modified oligonucleotides of any of embodiments 57-68, wherein all of the phosphorothioate internucleoside linkages of the modified oligonucleotide are stereorandom.

Embodiment 83. A pharmaceutical composition comprising the population of modified oligonucleotides of any of embodiments 77-82 and a pharmaceutically acceptable diluent or carrier.

Embodiment 84. A pharmaceutical composition of any of embodiments 62-75, and a pharmaceutically acceptable diluent or carrier.

Embodiment 85. The pharmaceutical composition of embodiment 84, wherein the pharmaceutically acceptable diluent is artificial cerebrospinal fluid or phosphate-buffered saline.

Embodiment 86. The pharmaceutical composition of embodiment 85, wherein the pharmaceutical composition consists essentially of the modified oligonucleotide and artificial cerebrospinal fluid or phosphate-buffered saline.

Embodiment 87. An oligomeric compound comprising a modified oligonucleotide consisting of 12 to 30 linked nucleosides wherein the nucleobase sequence of the modified oligonucleotide is at least 80% complementary to an equal length portion of an ATXN1 nucleic acid, and wherein the modified oligonucleotide comprises at least one modification selected from a modified sugar moiety and a modified internucleoside linkage.

Embodiment 88. The oligomeric compound of embodiment 87, wherein the ATXN1 nucleic acid has the nucleobase sequence of any of SEQ ID NO: 1, SEQ ID NO: 2, SEQ ID NO: 3, SEQ ID NO: 4, SEQ ID NO: 5, or SEQ ID NO: 6.

Embodiment 89. The oligomeric compound of embodiment 87 or embodiment 88, wherein the nucleobase sequence of the modified oligonucleotide is at least 80% complementary to an equal length portion within nucleobases:
an equal length portion of nucleobases 5472-5552 of SEQ ID NO: 1;
an equal length portion of nucleobases 5906-6005 of SEQ ID NO: 1;
an equal length portion of nucleobases 7868-7911 of SEQ ID NO: 1;
an equal length portion of nucleobases 8481-8514 of SEQ ID NO: 1; or
an equal length portion of nucleobases 446679-446706 of SEQ ID NO: 2.

Embodiment 90. The oligomeric compound of any of embodiments 87-89, wherein the nucleobase sequence of the modified oligonucleotide is at least 80% complementary to an equal length portion within nucleobases:
an equal length portion of nucleobases 5489-5508 of SEQ ID NO: 1;
an equal length portion of nucleobases 5491-5507 of SEQ ID NO: 1;
an equal length portion of nucleobases 5912-5931 of SEQ ID NO: 1;
an equal length portion of nucleobases 7892-7911 of SEQ ID NO: 1;
an equal length portion of nucleobases 8481-8500 of SEQ ID NO: 1; or
an equal length portion of nucleobases 446680-446699 of SEQ ID NO: 2.

Embodiment 91. The oligomeric compound of any of embodiments 87-90, wherein the nucleobase sequence of the modified oligonucleotide is at least 85%, at least 90%, at least 95%, or 100% complementary to an equal length portion of the ATXN1 nucleic acid.

Embodiment 92. An oligomeric compound comprising a modified oligonucleotide consisting of 12 to 30 linked nucleosides, wherein the modified oligonucleotide has a nucleobase sequence comprising at least 12, 13, 14, 15, 16, 17, 18, 19, or 20 contiguous nucleobases of any of SEQ ID NOs: 22-3624 or 3655.

Embodiment 93. An oligomeric compound comprising a modified oligonucleotide consisting of 12 to 30 linked nucleosides, wherein the modified oligonucleotide has a nucleobase sequence comprising at least 12, 13, 14, 15, 16, or 17 contiguous nucleobases of any of SEQ ID NOs: 3625-3654 or 3656-3669.

Embodiment 94. The oligomeric compound of embodiment 92 or 93, wherein the modified oligonucleotide has a nucleobase sequence comprising the nucleobase sequence of any of SEQ ID NO: 22-3669.

Embodiment 95. The oligomeric compound of embodiment 94, wherein the modified oligonucleotide has a nucleobase sequence consisting of the nucleobase sequence of any of SEQ ID NO: 22-3669.

Embodiment 96. The oligomeric compound of any of embodiments 92-95, wherein the modified oligonucleotide has a nucleobase sequence comprising at least 8, at least 9, at least 10, at least 11, at least 12, at least 13, at least 14, at least 15, at least 16, or at least 17 contiguous nucleobases of a sequence selected from:
SEQ ID NOs: 196, 274, 352, 430, 508, 2578, 2655, 2732, 2809, 2886, 2963, 3121, 3122, 3190, 3191, 3192, 3262, 3330, 3331, 3332, 3401, 3402, 3575, 3577, 3620, 3624, 3638-3640, 3653-3655, 3662, 3665, 3669;
SEQ ID Nos: 42, 120, 198, 276, 509, 587, 2502, 2579, 2656, 2733, 2810, 2887, 2964, 3585, 3588-3590, 3615, 3618, 3622, 3657, 3660, 3661, 3663, 3664, 3666-3668;
SEQ ID Nos: 48, 126, 2044, 2121;
SEQ ID Nos: 128, 206, 284, 1045, 1122, 1199, and 1276; or
SEQ ID Nos: 2475, 2552, 2629, 2706, 2783, 3627-3630, 3644.

Embodiment 97. The oligomeric compound of any of embodiments 92-95, wherein the modified oligonucleotide has a nucleobase sequence comprising at least 8, at least 9, at least 10, at least 11, at least 12, at least 13, at least 14, at least 15, at least 16, or 17 contiguous nucleobases of any of the nucleobase sequences of SEQ ID NO: 3638.

Embodiment 98. The oligomeric compound of any of embodiments 92-95, wherein the modified oligonucleotide has a nucleobase sequence comprising at least 8, at least 9, at least 10, at least 11, at least 12, at least 13, at least 14, at least 15, at least 16, at least 17, at least 18, at least 19, or 20 contiguous nucleobases of any of the nucleobase sequences of SEQ ID NO: 126, 1045, 2552, 3190, or 3590.

Embodiment 99. The oligomeric compound of embodiment 97 or 98, wherein the modified oligonucleotide consists of 17 to 30 linked nucleosides and has a nucleobase sequence comprising the nucleobase sequence of any of 126, 1045, 2552, 3190, 3590, or 3638.

Embodiment 100. The oligomeric compound of embodiment 99, wherein the modified oligonucleotide has a nucleobase sequence consisting of the nucleobase sequence of any one of 126, 1045, 2552, 3190, 3590, or 3638.

Embodiment 101. The oligomeric compound of any of embodiments 92-100, wherein the nucleobase sequence of the modified oligonucleotide is at least 85%, at least 90%, at least 95%, or 100% complementary to an equal length portion of the ATXN1 nucleic acid, wherein the ATXN1 nucleic acid has the nucleobase sequence of SEQ ID NO: 1, SEQ ID NO: 2, SEQ ID NO: 3, SEQ ID NO: 4, SEQ ID NO: 5, or SEQ ID NO: 6.

Embodiment 102. The oligomeric compound of any of embodiments 87-101, wherein at least one nucleoside of the modified oligonucleotide comprises a modified sugar moiety.

Embodiment 103. The oligomeric compound of embodiment 102, wherein the modified sugar moiety comprises a bicyclic sugar moiety.

Embodiment 104. The oligomeric compound of embodiment 103, wherein the bicyclic sugar moiety comprises a 2'-4' bridge selected from —O—CH$_2$—; and —O—CH(CH$_3$)—.

Embodiment 105. The oligomeric compound of any of embodiments 102-104, wherein the modified nucleoside comprises a non-bicyclic modified sugar moiety.

Embodiment 106. The oligomeric compound of embodiment 105, wherein the non-bicyclic modified sugar moiety is a 2'-MOE sugar moiety or 2'-OMe modified sugar moiety.

Embodiment 107. The oligomeric compound of any of embodiments 102-106, wherein at least one nucleoside of the modified oligonucleotide comprises a sugar surrogate.

Embodiment 108. The oligomeric compound of embodiment 107, wherein the sugar surrogate is selected from morpholino and PNA.

Embodiment 109. The oligomeric compound of any of embodiments 87-102 or 105-108, wherein the modified oligonucleotide does not comprise a bicyclic sugar moiety.

Embodiment 110. The oligomeric compound of any of embodiments 87-109, wherein the modified oligonucleotide comprises at least one modified internucleoside linkage.

Embodiment 111. The oligomeric compound of embodiment 110, wherein at least one modified internucleoside linkage is a phosphorothioate internucleoside linkage.

Embodiment 112. The oligomeric compound of embodiment 110 or 111, wherein each internucleoside linkage is a modified internucleoside linkage.

Embodiment 113. The oligomeric compound of embodiment 112, wherein each internucleoside linkage is a phosphorothioate internucleoside linkage.

Embodiment 114. The oligomeric compound of any of embodiments 110-111, wherein at least one internucleoside linkage of the modified oligonucleotide is a phosphodiester internucleoside linkage.

Embodiment 115. The oligomeric compound of any of embodiments 87-109, wherein each internucleoside linkage of the modified oligonucleotide is independently selected from a phosphodiester or a phosphorothioate internucleoside linkage.

Embodiment 116. The oligomeric compound of any of embodiments 87-115, wherein at least 10, at least 11, at least 12, at least 13, at least 14, at least 15, at least 16, at least 17, or at least 18 internucleoside linkages of the modified oligonucleotide are phosphorothioate internucleoside linkages.

Embodiment 117. The oligomeric compound of embodiment 116, wherein the modified oligonucleotide has an internucleoside linkage motif selected from: sooosssssssssssooss, sssosssssssssssosss, sssosssssssss-soss, or soooooosssssssssssoss; wherein,
s=a phosphorothioate internucleoside linkage and o=a phosphodiester internucleoside linkage.

Embodiment 118. The oligomeric compound of any of embodiments 87-117, wherein the modified oligonucleotide comprises a modified nucleobase.

Embodiment 119. The oligomeric compound of embodiment 118, wherein the modified nucleobase is a 5-methyl cytosine.

Embodiment 120. The oligomeric compound of any of embodiments 1-33, wherein the modified oligonucleotide comprises a deoxy region consisting of 5-12 contiguous 2'-deoxynucleosides.

Embodiment 121. The oligomeric compound of embodiment 120, wherein each nucleoside of the deoxy region is a 2'-β-D-deoxynucleoside.

Embodiment 122. The oligomeric compound of embodiment 120 or 121 wherein the deoxy region consists of 6, 7, 8, 9, 10, or 6-10 linked nucleosides.

Embodiment 123. The oligomeric compound of any of embodiments 120-122, wherein each nucleoside immediately adjacent to the deoxy region comprises a modified sugar moiety.

Embodiment 124. The oligomeric compound of any of embodiments 120-122, wherein the deoxy region is flanked on the 5'-side by a 5'-region consisting of 1-6 linked 5'-region nucleosides and on the 3'-side by a 3'external region consisting of 1-6 linked 3'-region nucleosides; wherein
the 3'-most nucleoside of the 5'-region comprises a modified sugar moiety; and
the 5'-most nucleoside of the 3'-region comprises a modified sugar moiety.

Embodiment 125. The oligomeric compound of embodiment 124, wherein each nucleoside of the 3'-region comprises a modified sugar moiety.

Embodiment 126. The oligomeric compound of embodiment 124 or 125, wherein each nucleoside of the 5'-region comprises a modified sugar moiety.

Embodiment 127. The oligomeric compound of embodiment 120-126, wherein the modified oligonucleotide has
a 5'-region consisting of 1-6 linked nucleosides;
a deoxy region consisting of 6-10 linked nucleosides; and
a 3'-region consisting of 1-6 linked nucleosides; wherein each of the 5'-region nucleosides and each of the 3'-region nucleosides comprises a modified sugar moiety.

Embodiment 128. The oligomeric compound of embodiment 127, wherein the modified oligonucleotide has
a 5'-region consisting of 6 linked nucleosides;
a deoxy region consisting of 10 linked nucleosides; and
a 3'-region consisting of 4 linked nucleosides; wherein each of the 5'-region nucleosides and each of the 3'-region nucleosides is a 2'-MOE nucleoside, and each of the deoxy region nucleosides is a 2'-β-D-deoxynucleoside.

Embodiment 129. The oligomeric compound of embodiment 127, wherein the modified oligonucleotide has
a 5'-region consisting of 5 linked nucleosides;
a central region consisting of 10 linked nucleosides; and
a 3'-region consisting of 5 linked nucleosides; wherein each of the 5'-region nucleosides and each of the 3'-region nucleosides is a 2'-MOE nucleoside, and each of the deoxy region nucleosides is a 2'-β-D-deoxynucleoside.

Embodiment 130. The oligomeric compound of embodiment 127, wherein the modified oligonucleotide has
a 5'-region consisting of 5 linked nucleosides;
a deoxy region consisting of 8 linked nucleosides; and
a 3'-region consisting of 4 linked nucleosides; wherein each of the 5'-region nucleosides and each of the 3'-region nucleosides is a 2'-MOE nucleoside, and each of the deoxy region nucleosides is a 2'-β-D-deoxynucleoside.

Embodiment 131. The oligomeric compound of embodiment 127, wherein the modified oligonucleotide has
a 5'-region consisting of 5 linked nucleosides;
a deoxy region consisting of 8 linked nucleosides; and
a 3'-region consisting of 4 linked nucleosides; wherein each of the 5'-region nucleosides is a 2'-MOE nucleoside, each of the 3'-region nucleosides is selected from a 2'-MOE nucleoside and a cEt nucleoside, and each of the deoxy region nucleosides is a 2'-β-D-deoxynucleoside.

Embodiment 132. The oligomeric compound of any of embodiments 87-119, wherein the modified oligonucleotide has
a 5' region consisting of 3-7 linked nucleosides;
a deoxy region consisting of 6-8 linked nucleosides; and
a 3' region consisting of 3-6 linked nucleosides; wherein
each of the 3' region nucleosides is selected from a 2'-MOE nucleoside and a cEt nucleoside, and the 5' region has the following formula:

(Nk)n(Nd)(Nx)

wherein each Nk is a bicyclic nucleoside, Nx is a 2'-OMe nucleoside and Nd is a 2'-β-D-deoxynucleoside;
and n is from 1-5.

Embodiment 133. The oligomeric compound of any of embodiments 87-119, wherein the modified oligonucleotide has
a 5' region consisting of 7 linked nucleosides;
a deoxy region consisting of 6 linked nucleosides; and
a 3' region consisting of 4 linked nucleosides; wherein
each of the 3' region nucleosides is selected from a 2'-MOE nucleoside and a cEt nucleoside, and the 5' region has the following formula:

(Nk)n(Nd)(Nx)

wherein each Nk is a bicyclic nucleoside, Nx is a 2'-OMe nucleoside and Nd is a 2'-β-D-deoxynucleoside;
and n is from 5.

Embodiment 134. The oligomeric compound of any of embodiments 87-133, wherein the modified oligonucleotide consists of 12-30, 12-22, 12-20, 14-18, 16-18, 14-20, 15-17, 15-25, 16-20, or 17-20 linked nucleosides.

Embodiment 135. The oligomeric compound of any of embodiments 87-132, wherein the modified oligonucleotide consists of 18-22 or 18-20 linked nucleosides.

Embodiment 136. The oligomeric compound of any of embodiments 87-133, wherein the modified oligonucleotide consists of 17 linked nucleosides.

Embodiment 137. The oligomeric compound of any of embodiments 87-132, wherein the modified oligonucleotide consists of 20 linked nucleosides.

Embodiment 138. A compound comprising a modified oligonucleotide according to the following chemical notation:
Ges $^m$Ceo Aeo $^m$Ceo Ges Gds Tds Ads Tds Tds Ads Gds Tds Gds Tds $^m$Ceo Teo Tes $^m$Ces Ae (SEQ ID NO: 126), wherein,
A=an adenine nucleobase,
$^m$C=a 5-methyl cytosine nucleobase,
G=a guanine nucleobase,
T=a thymine nucleobase,
e=a 2'-MOE sugar moiety,
d=a 2'-β-D deoxyribosyl sugar moiety,
s=a phosphorothioate internucleoside linkage, and
o=a phosphodiester internucleoside linkage.

Embodiment 139. A compound comprising a modified oligonucleotide according to the following chemical notation:
Ges $^m$Ceo Teo Teo $^m$Ces Tds $^m$Cds Ads Ads Ads Tds $^m$Cds Ads Gds Gds Teo Geo Tes Aes mCe (SEQ ID NO: 1045), wherein,
A=an adenine nucleobase,
$^m$C=a 5-methyl cytosine nucleobase,
G=a guanine nucleobase,
T=a thymine nucleobase,
e=a 2'-MOE sugar moiety,
d=a 2'-β-D deoxyribosyl sugar moiety,
s=a phosphorothioate internucleoside linkage, and
o=a phosphodiester internucleoside linkage.

Embodiment 140. A compound comprising a modified oligonucleotide according to the following chemical notation:
Ges $^m$Ceo $^m$Ceo Teo Tes Tds Ads Tds Ads Ads $^m$Cds Tds Tds Tds Tds $^m$Ceo Teo Tes Tes $^m$Ce (SEQ ID NO: 2552), wherein,
A=an adenine nucleobase,
$^m$C=a 5-methyl cytosine nucleobase,
G=a guanine nucleobase,
T=a thymine nucleobase,
e=a 2'-MOE sugar moiety,
d=a 2'-β-D deoxyribosyl sugar moiety,
s=a phosphorothioate internucleoside linkage, and
o=a phosphodiester internucleoside linkage.

Embodiment 141. A compound comprising a modified oligonucleotide according to the following chemical notation:

Tes Teo $^m$Ceo Aeo Ges Tds Tds Tds Ads Gds Tds Tds Gds $^m$Cds Ads Geo $^m$Ceo $^m$Ces Aes Te (SEQ ID NO: 3190), wherein,
A=an adenine nucleobase,
$^m$C=a 5-methyl cytosine nucleobase,
G=a guanine nucleobase,
T=a thymine nucleobase,
e=a 2'-MOE sugar moiety,
d=a 2'-β-D deoxyribosyl sugar moiety,
s=a phosphorothioate internucleoside linkage, and
o=a phosphodiester internucleoside linkage.

Embodiment 142. A compound comprising a modified oligonucleotide according to the following chemical notation:
$^m$Ces $^m$Ceo $^m$Ceo Geo Tes Ads Tds Tds $^m$Cds $^m$Cds Tds $^m$Cds Tds Tds Ads $^m$Ceo $^m$Ceo Aes Tes $^m$Ce (SEQ ID NO: 3590), wherein,
A=an adenine nucleobase,
$^m$C=a 5-methyl cytosine nucleobase,
G=a guanine nucleobase,
T=a thymine nucleobase,
e=a 2'-MOE sugar moiety,
d=a 2'-β-D deoxyribosyl sugar moiety,
s=a phosphorothioate internucleoside linkage, and
o=a phosphodiester internucleoside linkage.

Embodiment 143. A compound comprising a modified oligonucleotide according to the following chemical notation:
Tes $^m$Ces Aes Geo Tes Tds Tds Ads Gds Tds Tds Gds $^m$Cds Aeo Ges $^m$Ces $^m$Ce (SEQ ID NO: 3638), wherein,
A=an adenine nucleobase,
$^m$C=a 5-methyl cytosine nucleobase,
G=a guanine nucleobase,
T=a thymine nucleobase,
e=a 2'-MOE sugar moiety,
d=a 2'-β-D deoxyribosyl sugar moiety,
s=a phosphorothioate internucleoside linkage, and
o=a phosphodiester internucleoside linkage.

Embodiment 144. The oligomeric compound of any of embodiments 87-143, consisting of the modified oligonucleotide.

Embodiment 145. The oligomeric compound of any of embodiments 87-144, comprising a conjugate group comprising a conjugate moiety and a conjugate linker.

Embodiment 146. The oligomeric compound of embodiment 145, wherein the conjugate linker consists of a single bond.

Embodiment 147. The oligomeric compound of embodiment 145, wherein the conjugate linker is cleavable.

Embodiment 148. The oligomeric compound of embodiment 145, wherein the conjugate linker comprises 1-3 linker nucleosides.

Embodiment 149. The oligomeric compound of any of embodiments 145-148, wherein the conjugate linker does not comprise any linker nucleosides.

Embodiment 150. The oligomeric compound of any of embodiments 145-148, wherein the conjugate group is attached to the modified oligonucleotide at the 5'-end of the modified oligonucleotide.

Embodiment 151. The oligomeric compound of any of embodiments 145-148, wherein the conjugate group is attached to the modified oligonucleotide at the 3'-end of the modified oligonucleotide.

Embodiment 152. The oligomeric compound of any of embodiments 87-143 or 146-148, comprising a terminal group.

Embodiment 153. The oligomeric compound of embodiment 152, wherein the terminal group is an abasic sugar moiety.

Embodiment 154. The oligomeric compound of any of embodiments 87-153 wherein the oligomeric compound is a singled-stranded oligomeric compound.

Embodiment 155. A modified oligonucleotide according to the following chemical structure:

(SEQ ID NO: 126)

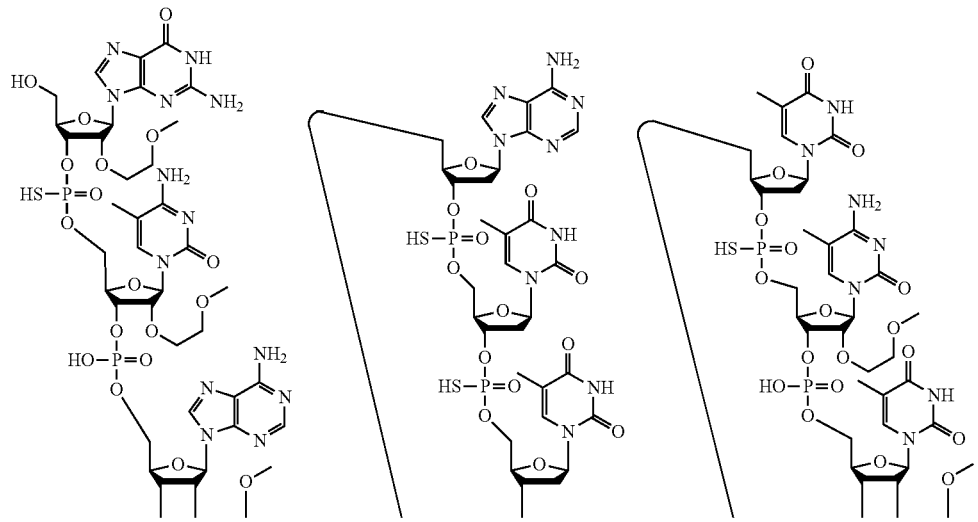

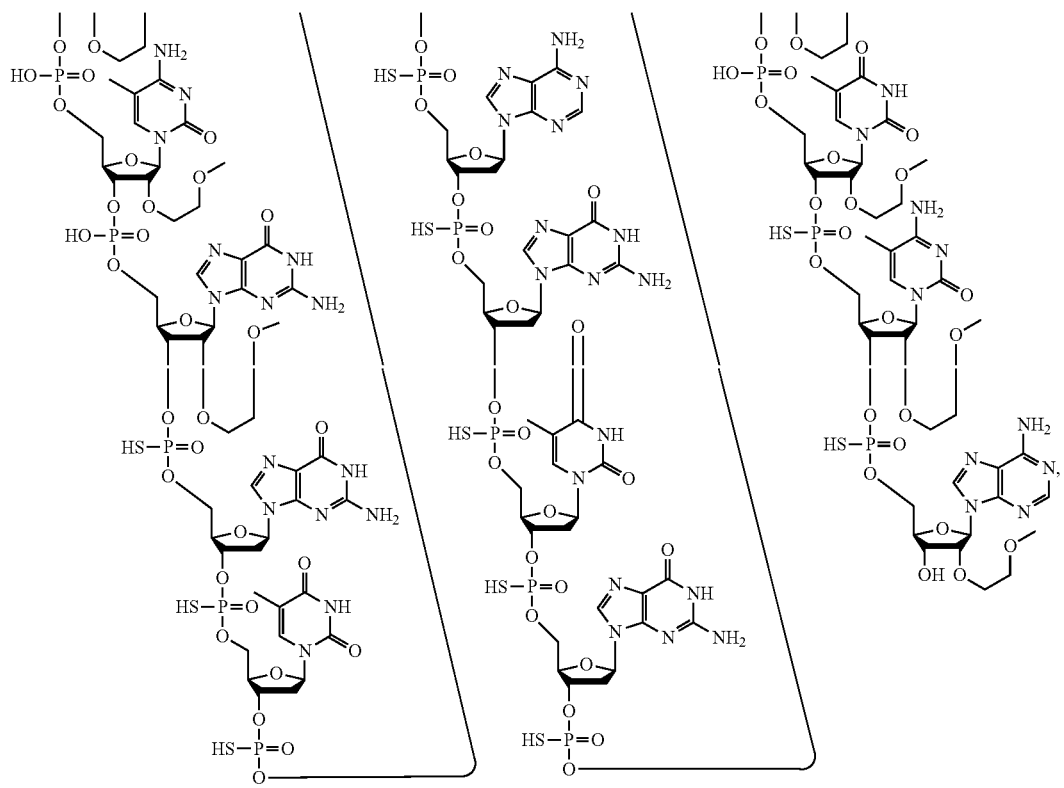
or a salt thereof.
Embodiment 156. A modified oligonucleotide according to the following chemical structure:
(SEQ ID NO: 1045)
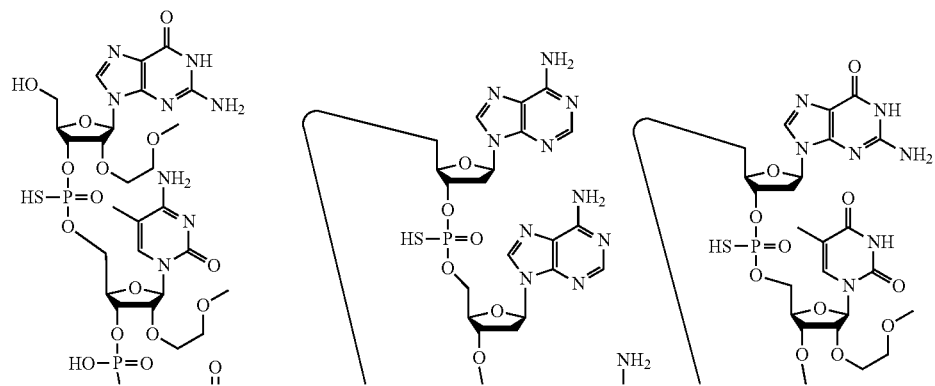

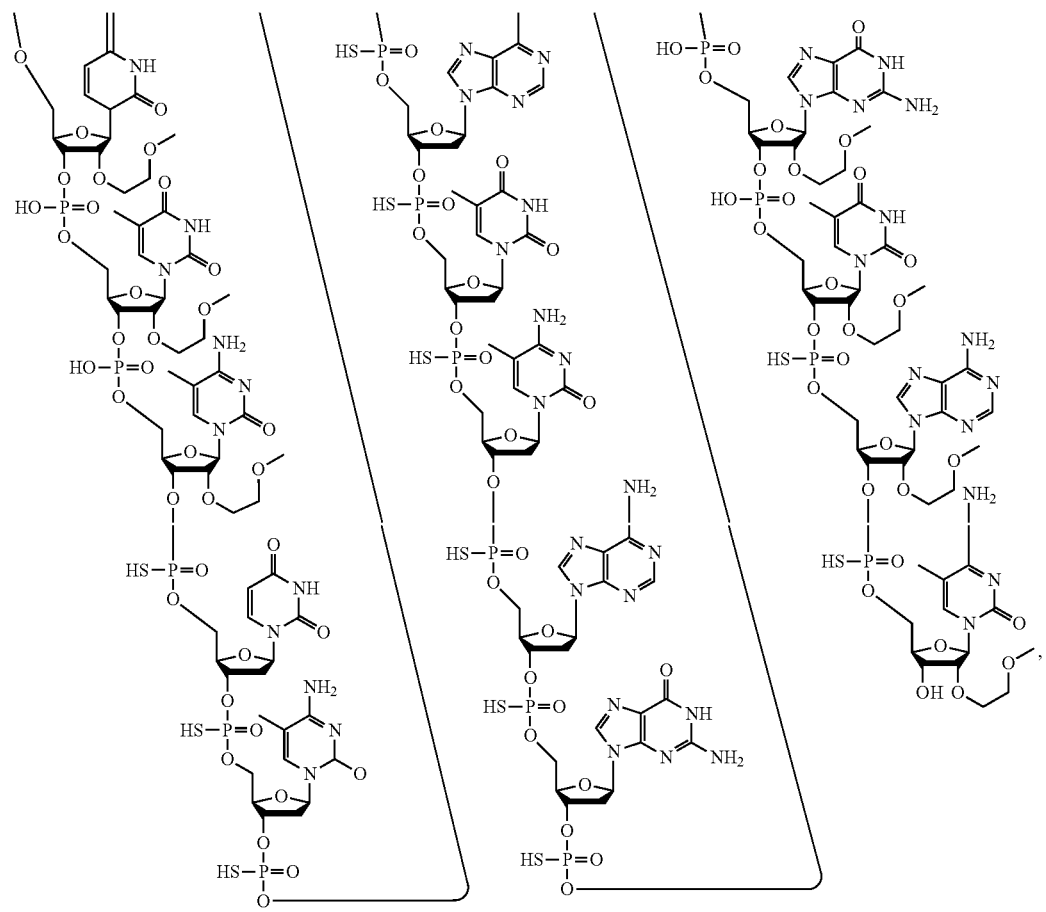
or a salt thereof.
Embodiment 157. A modified oligonucleotide according to the following chemical structure:
(SEQ ID NO: 2552)
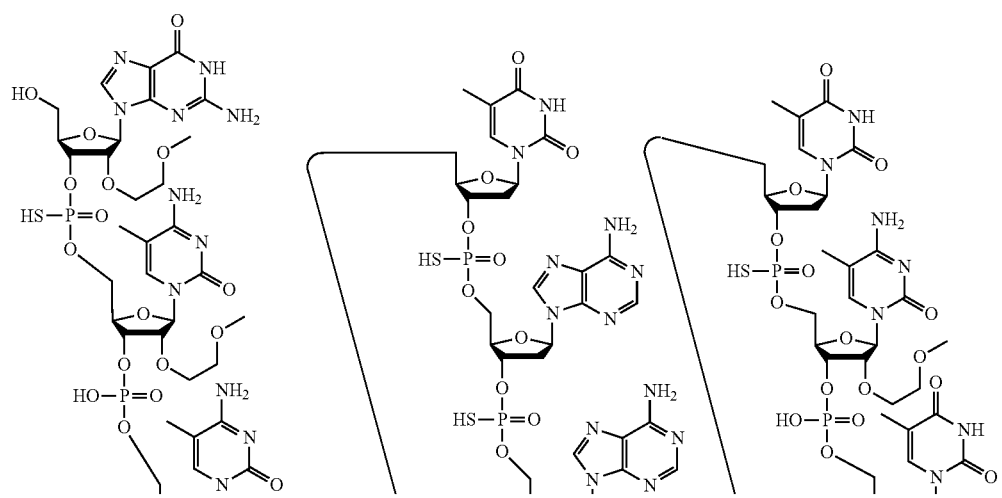

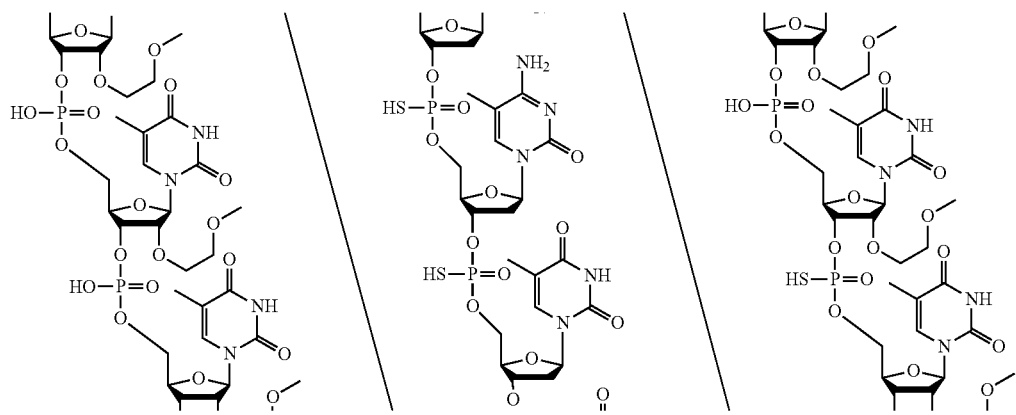
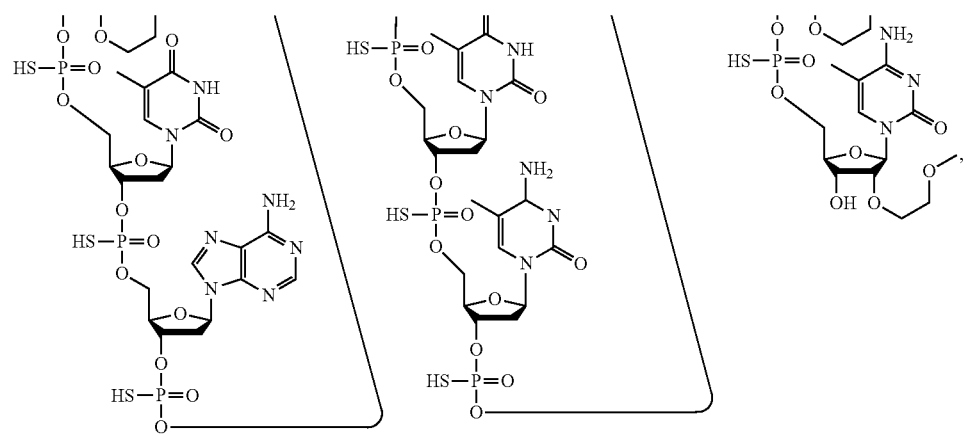
or a salt thereof.
Embodiment 158. A modified oligonucleotide according to the following chemical structure:
(SEQ ID NO: 3190)
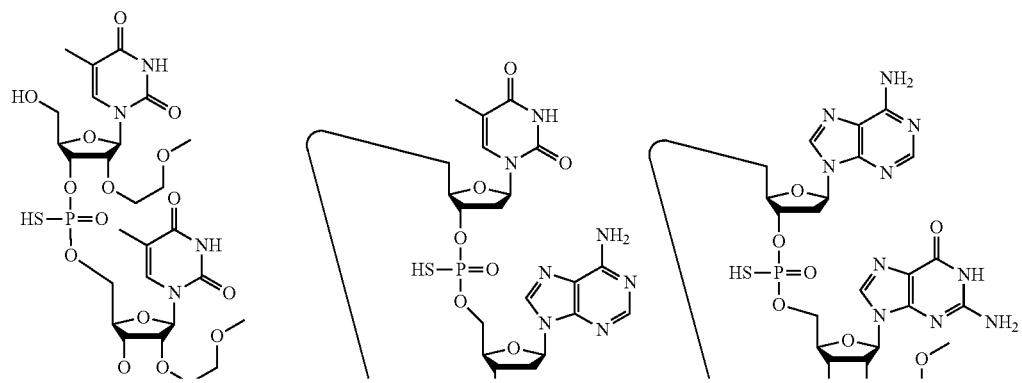

-continued
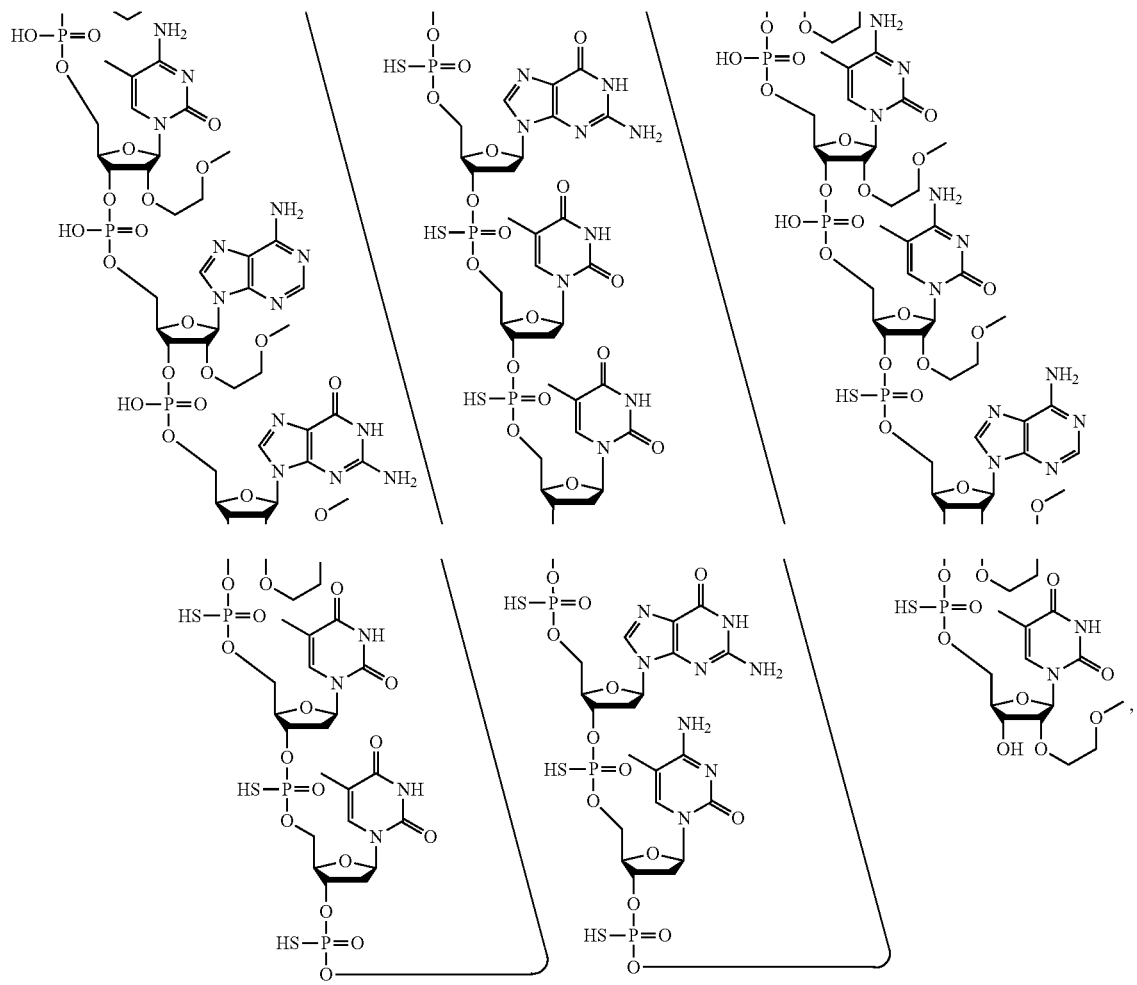
or a salt thereof.
Embodiment 159. A modified oligonucleotide according to the following chemical structure:
(SEQ ID NO: 3590)
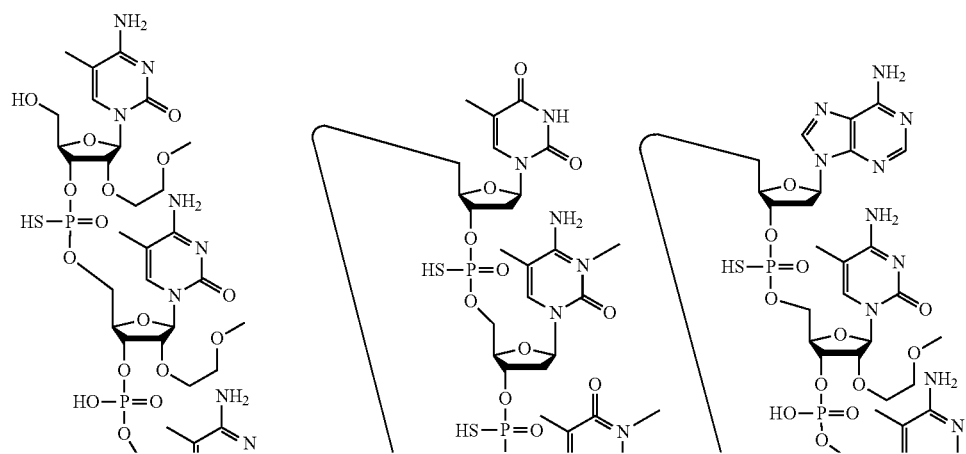

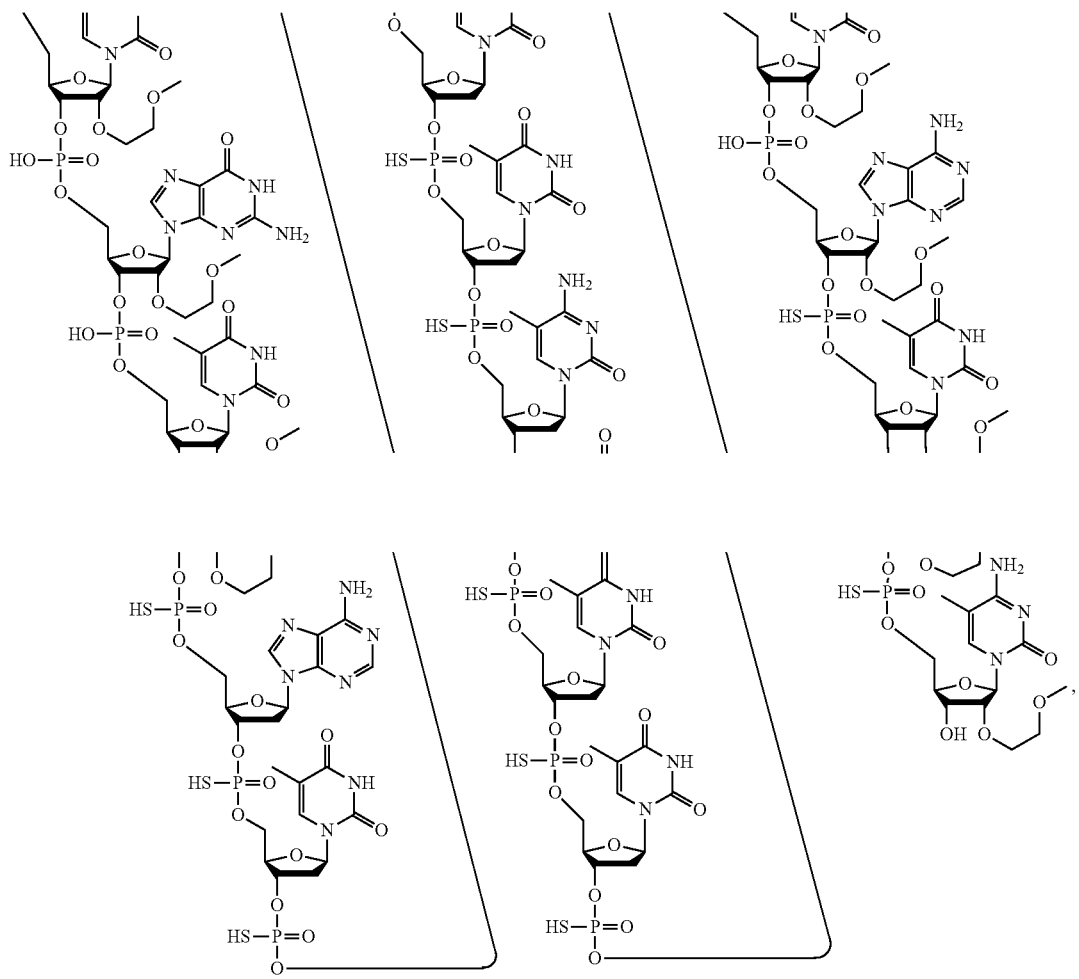
or a salt thereof.
Embodiment 160. A modified oligonucleotide according to the following chemical structure:
(SEQ ID NO: 3638)
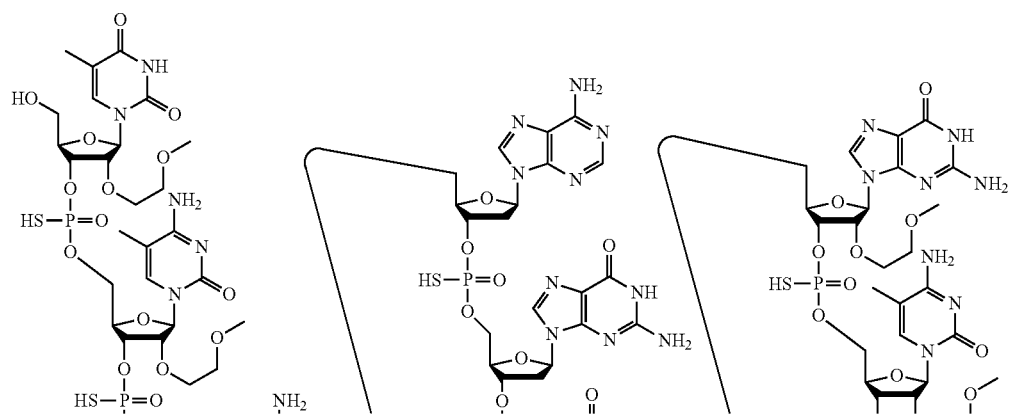

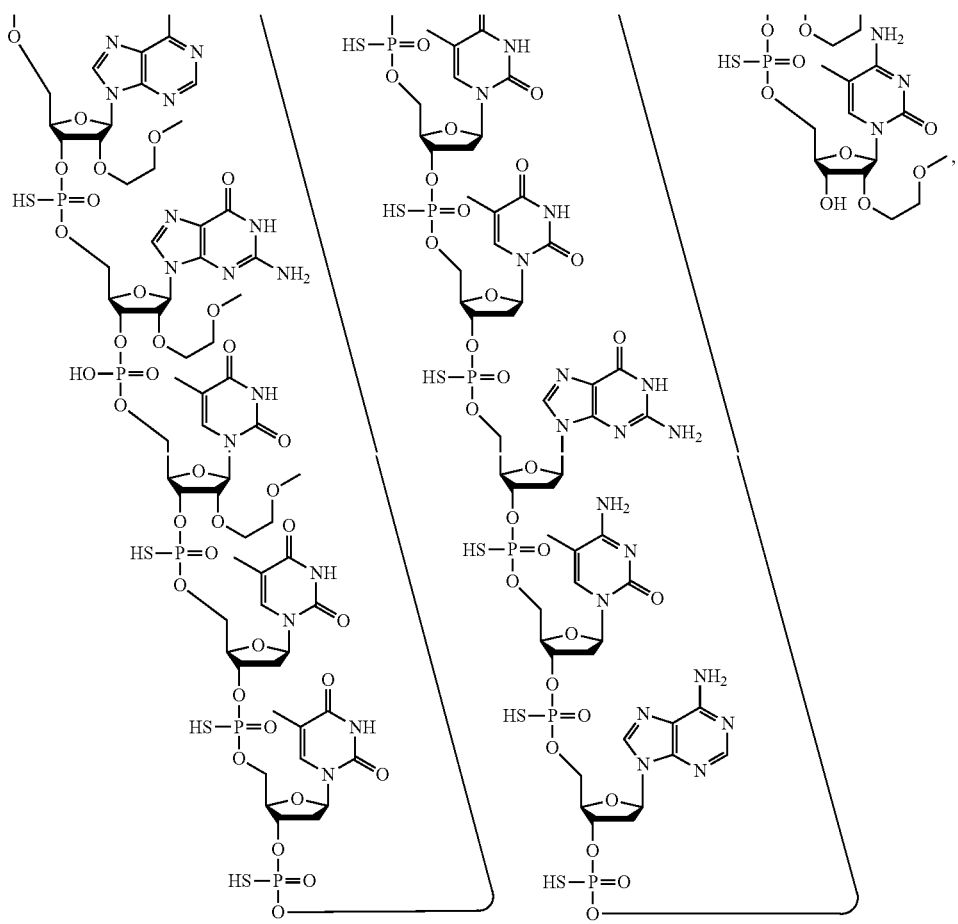
or a salt thereof.
Embodiment 161. The modified oligonucleotide of any of embodiments 155-160, which is the sodium salt or the potassium salt.
Embodiment 162. A modified oligonucleotide according to the following chemical structure:
(SEQ ID NO: 126)
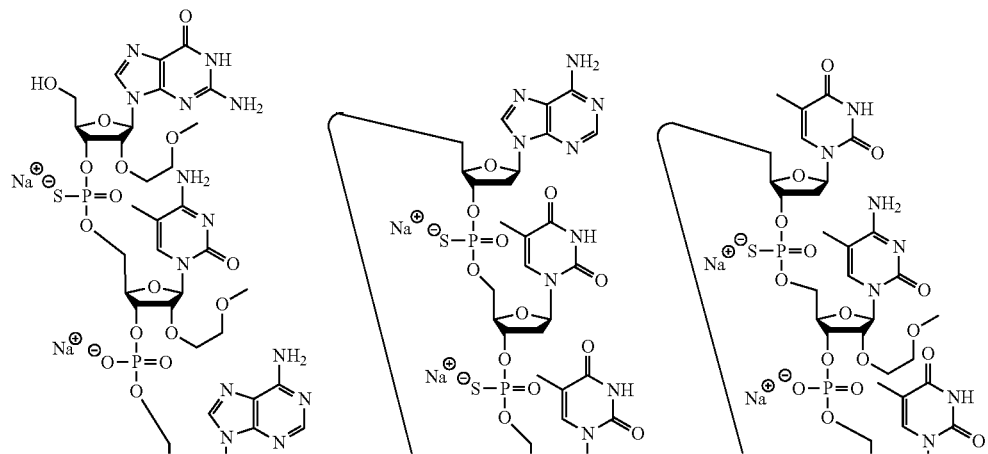

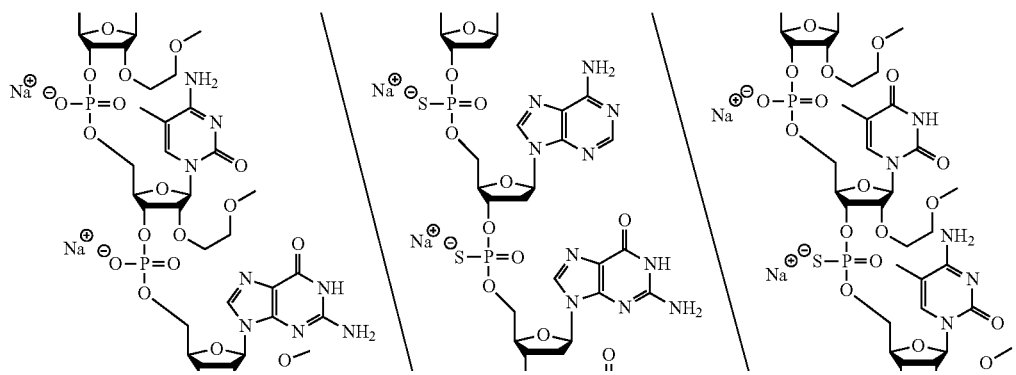
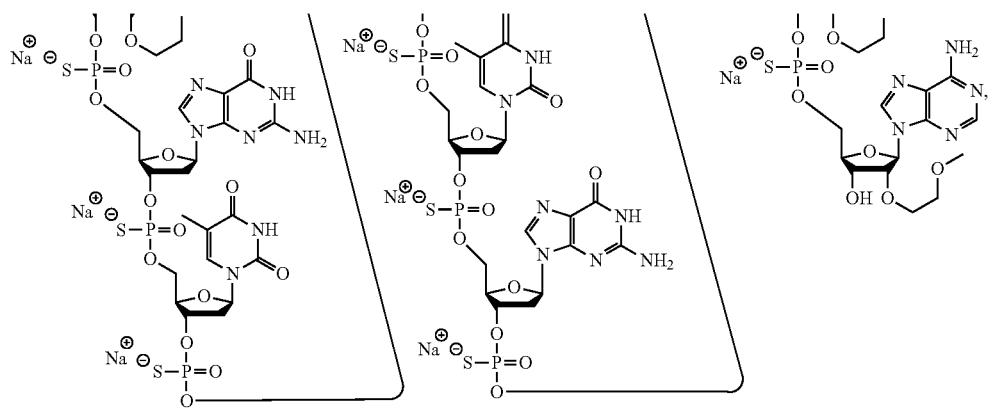
Embodiment 163. A modified oligonucleotide according to the following chemical structure:
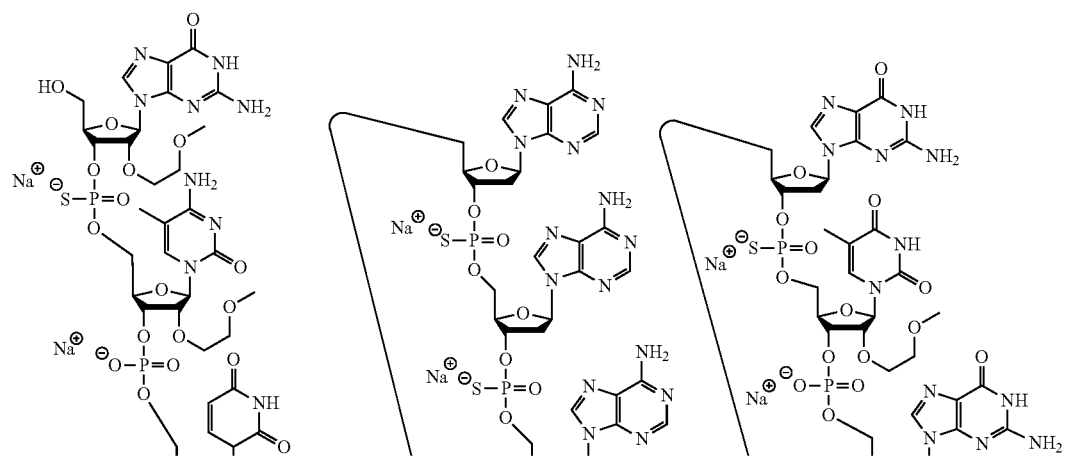
(SEQ ID NO: 1045)

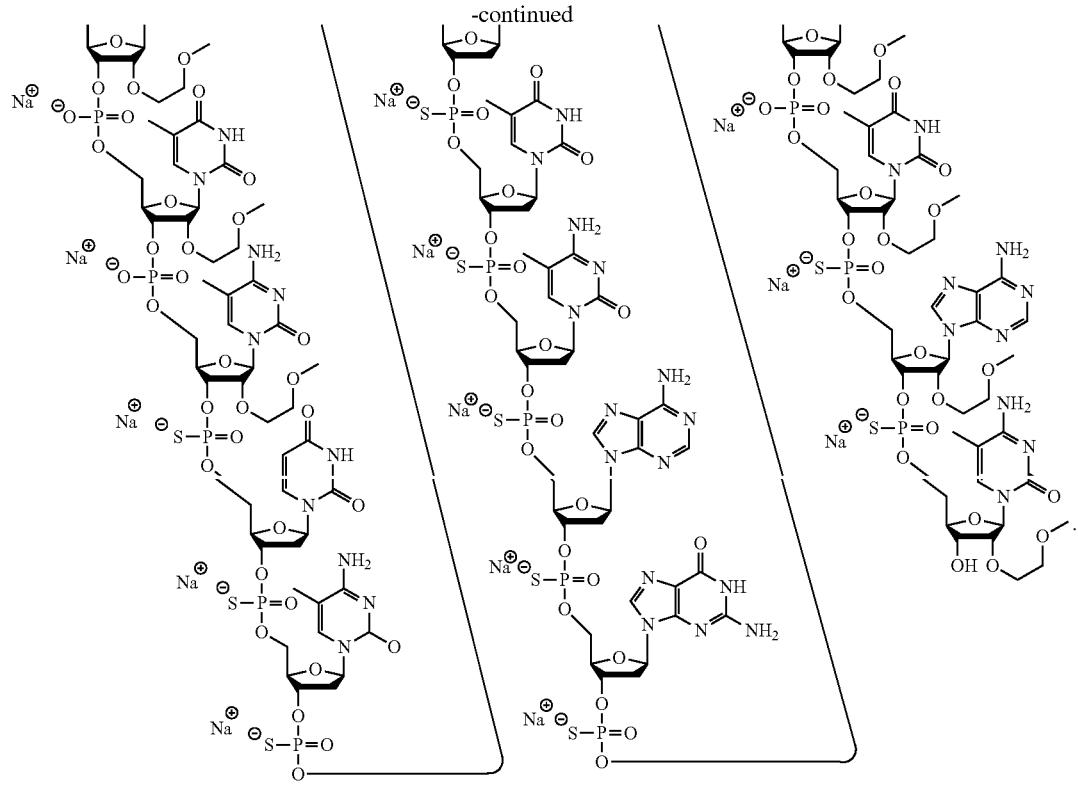
Embodiment 164. A modified oligonucleotide according to the following chemical structure:
(SEQ ID NO: 2552)
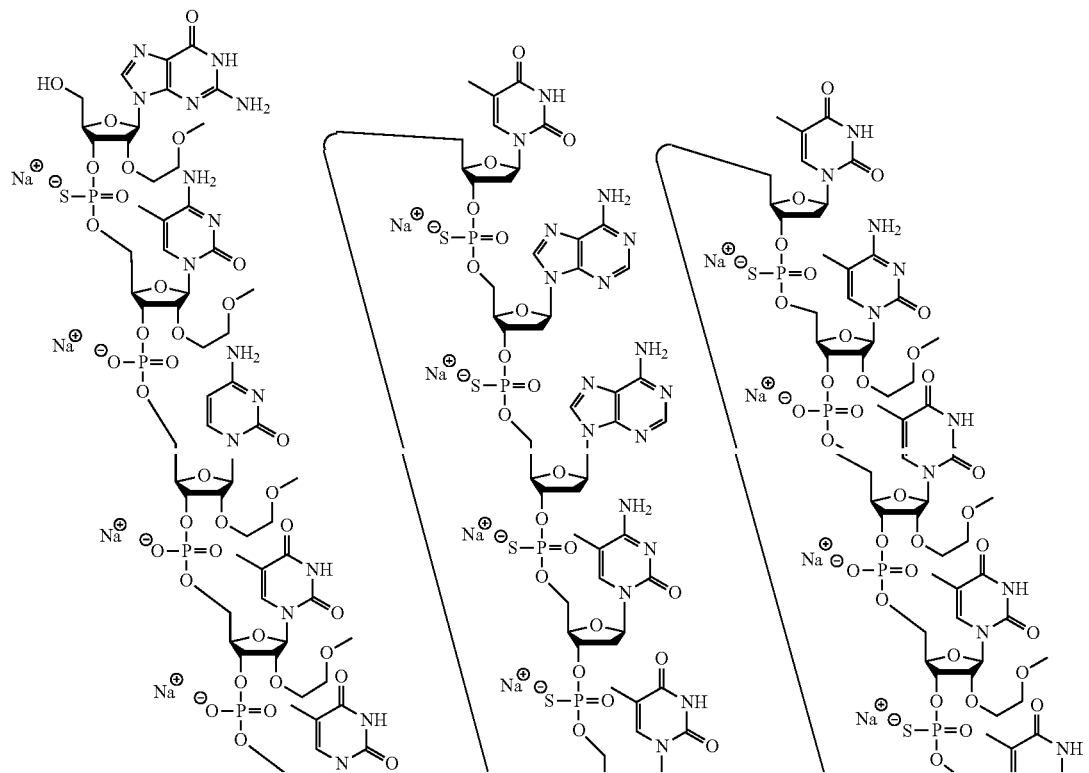

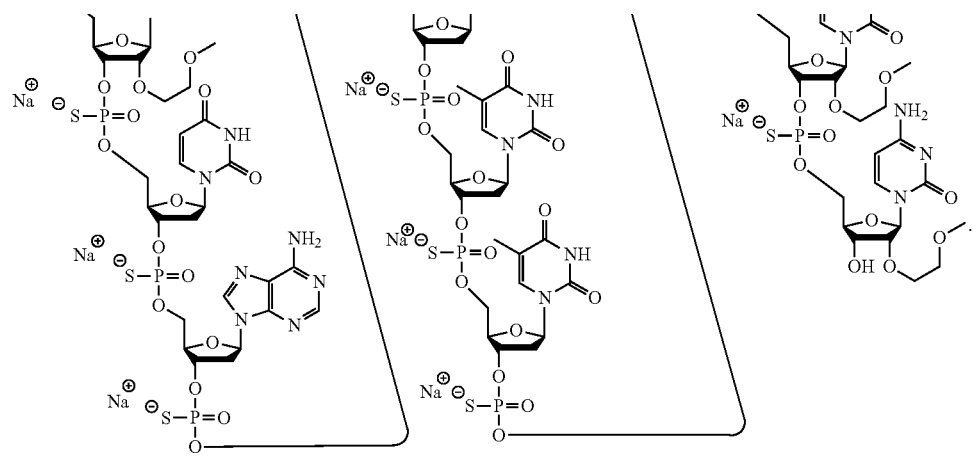
Embodiment 165. A modified oligonucleotide according to the following chemical structure:
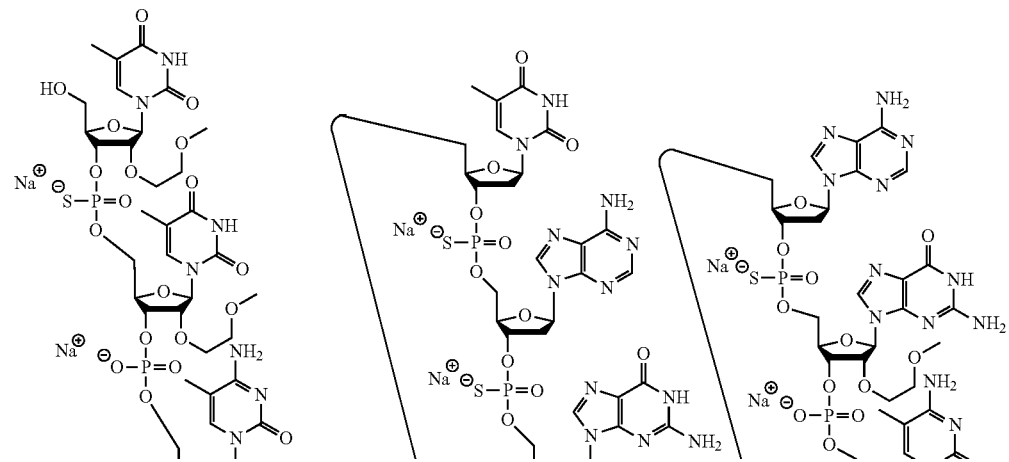
(SEQ ID NO: 3190)
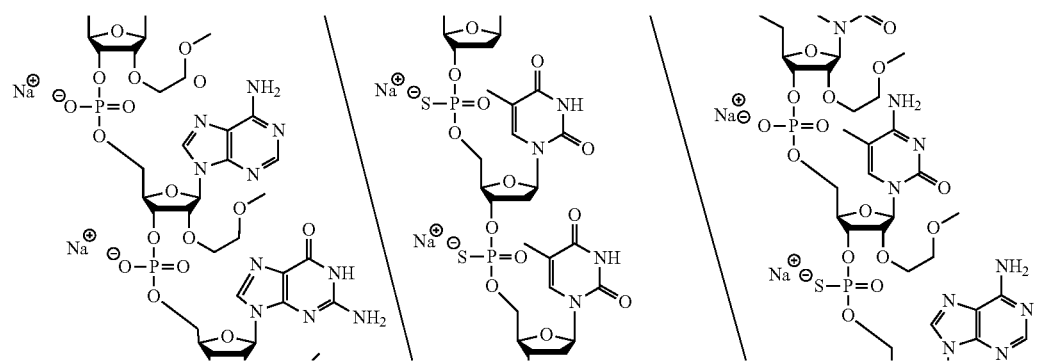

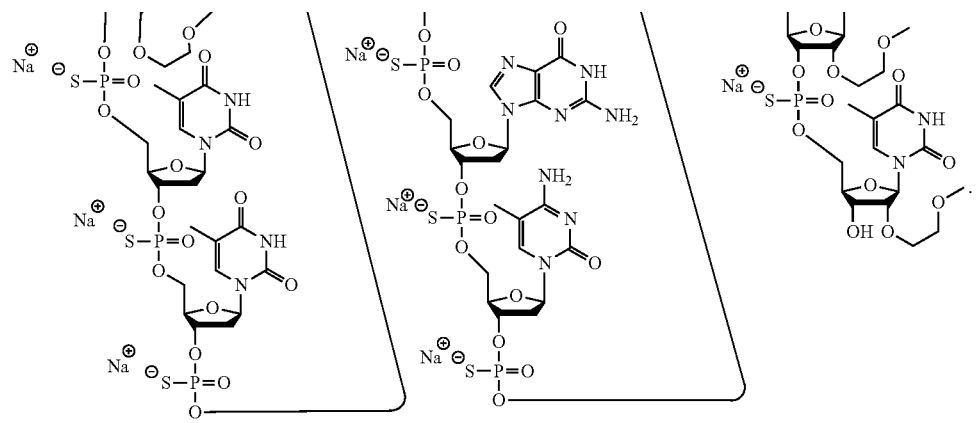
Embodiment 166. A modified oligonucleotide according to the following chemical structure:
(SEQ ID NO: 3590)
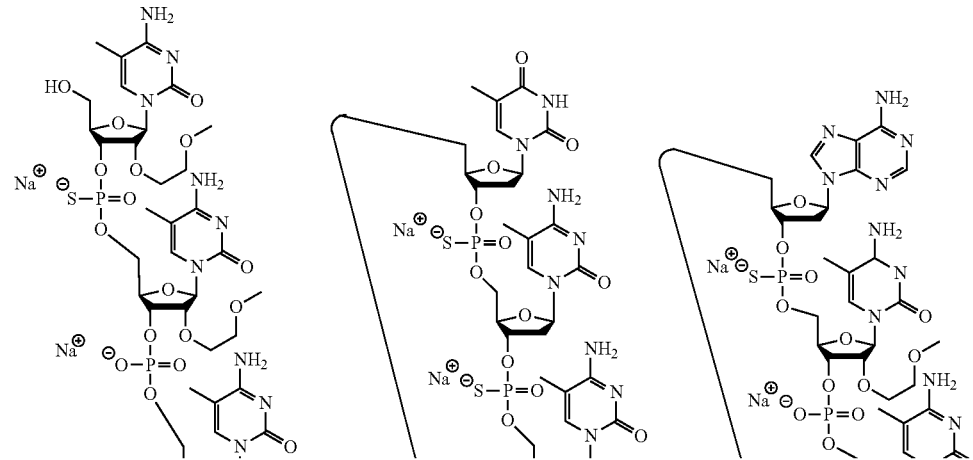
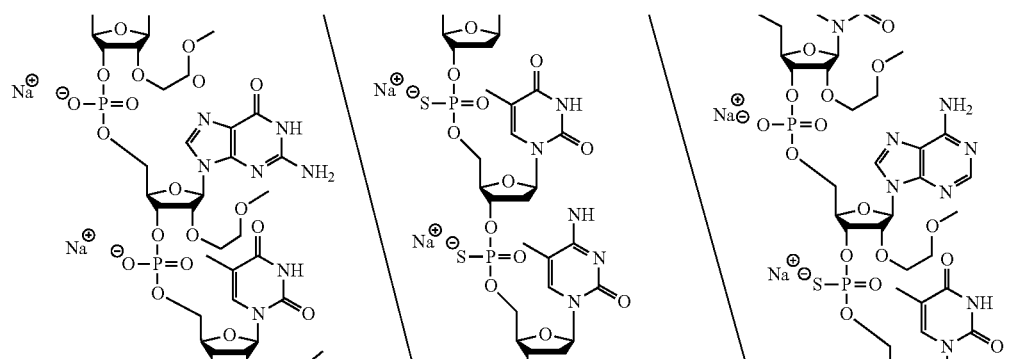

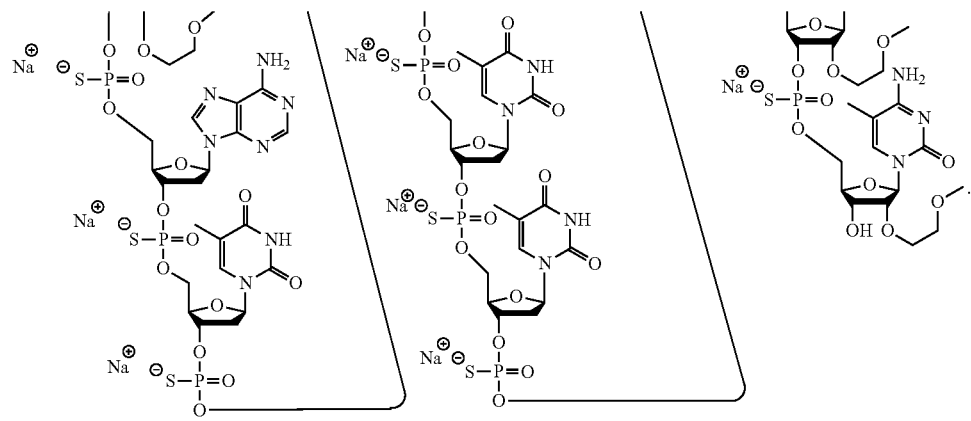
Embodiment 167. A modified oligonucleotide according to the following chemical structure:
(SEQ ID NO: 3638)
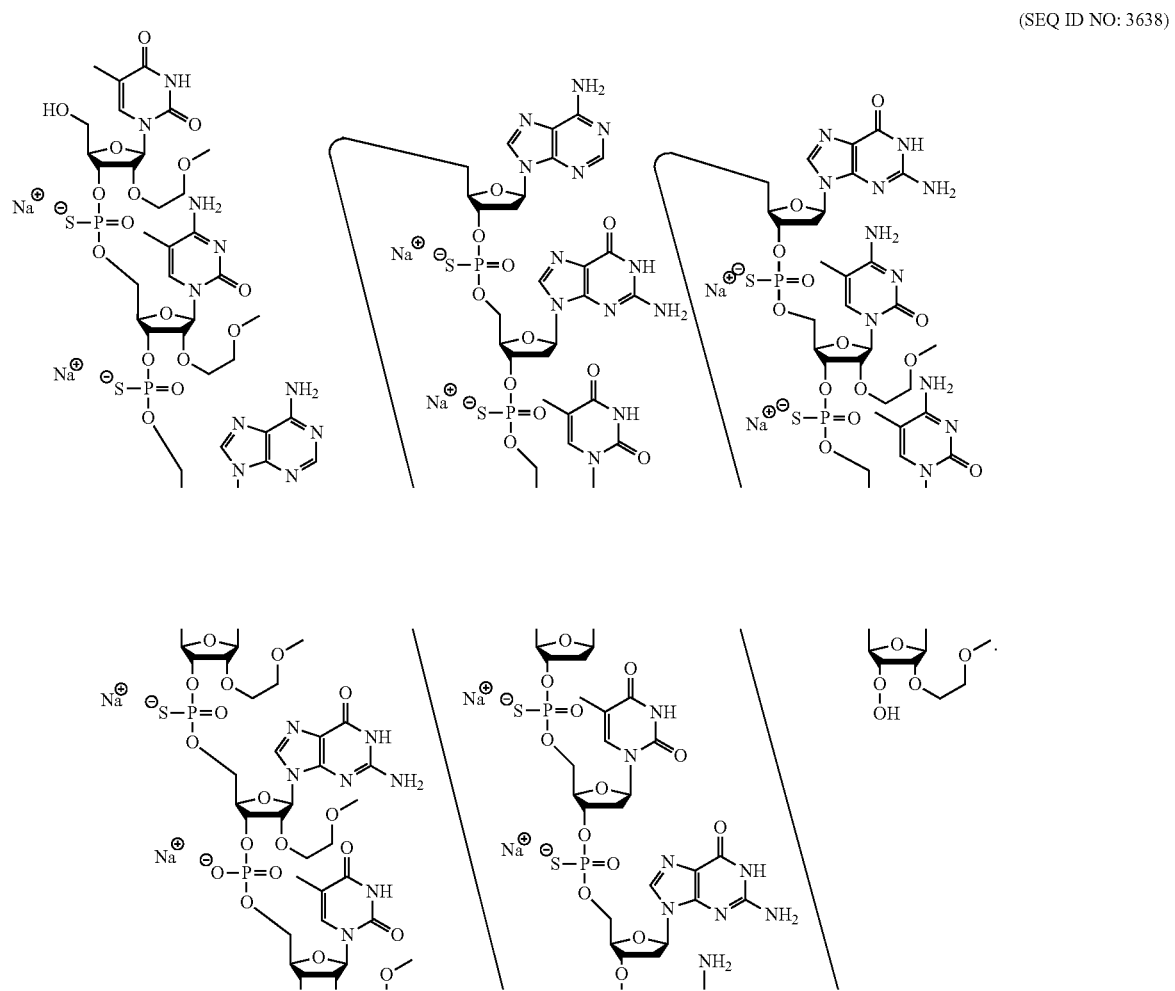

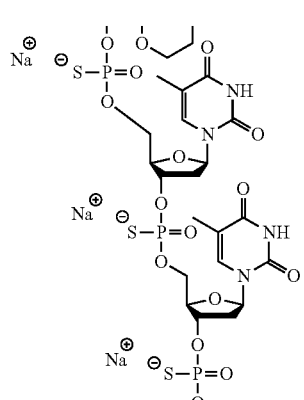
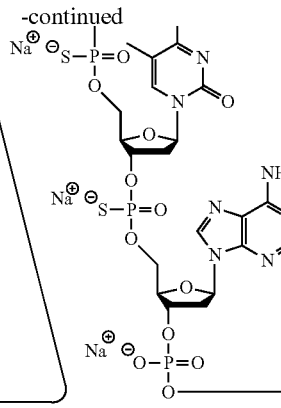
-continued

Embodiment 168. A chirally enriched population of oligomeric compounds of any of embodiments 87-154 or modified oligonucleotide of embodiments 155-167, wherein the population is enriched for modified oligonucleotides comprising at least one particular phosphorothioate internucleoside linkage having a particular stereochemical configuration.

Embodiment 169. The chirally enriched population of embodiment 168, wherein the population is enriched for modified oligonucleotides comprising at least one particular phosphorothioate internucleoside linkage having the (Sp) or (Rp) configuration.

Embodiment 170. The chirally enriched population of embodiment 169, wherein the population is enriched for modified oligonucleotides having a particular, independently selected stereochemical configuration at each phosphorothioate internucleoside linkage.

Embodiment 171. The chirally enriched population of embodiment 170, wherein the population is enriched for modified oligonucleotides having the (Rp) configuration at one particular phosphorothioate internucleoside linkage and the (Sp) configuration at each of the remaining phosphorothioate internucleoside linkages.

Embodiment 172. The chirally enriched population of embodiment 171, wherein the population is enriched for modified oligonucleotides having at least 3 contiguous phosphorothioate internucleoside linkages in the Sp, Sp, and Rp configurations, in the 5' to 3' direction.

Embodiment 173. A population of oligomeric compounds comprising modified oligonucleotides of any of embodiments 87-154, or a population of modified oligonucleotides of embodiments 155-167, wherein all of the phosphorothioate internucleoside linkages of the modified oligonucleotide are stereorandom.

Embodiment 174. An oligomeric duplex, comprising a first oligomeric compound and a second oligomeric compound comprising a second modified oligonucleotide, wherein the first oligomeric compound is an oligomeric compound of any of embodiments 87-154.

Embodiment 175. The oligomeric duplex of embodiment 174, wherein the second oligomeric compound comprises a second modified oligonucleotide consisting of 12 to 30 linked nucleosides, and wherein the nucleobase sequence of the second modified oligonucleotide comprises a complementary region of at least 8 nucleobases that is at least 90% complementary to an equal length portion of the first modified oligonucleotide.

Embodiment 176. The oligomeric duplex of embodiment 174 or 175, wherein the modified oligonucleotide of the first oligomeric compound comprises a 5'-stabilized phosphate group.

Embodiment 177. The oligomeric duplex of embodiment 176, wherein the stabilized phosphate group comprises a cyclopropyl phosphonate or a vinyl phosphonate.

Embodiment 178. The oligomeric duplex of any of embodiments 174-177, wherein the modified oligonucleotide of the first oligomeric compound comprises a glycol nucleic acid (GNA) sugar surrogate.

Embodiment 179. The oligomeric duplex of any of embodiments 174-178, wherein the modified oligonucleotide of the first oligomeric compound comprises a 2'-NMA sugar moiety.

Embodiment 180. The oligomeric duplex of any of embodiments 174-179, wherein at least one nucleoside of the second modified oligonucleotide comprises a modified sugar moiety.

Embodiment 181. The oligomeric duplex of embodiment 180, wherein the modified sugar moiety of the second modified oligonucleotide comprises a bicyclic sugar moiety.

Embodiment 182. The oligomeric duplex of embodiment 181, wherein the bicyclic sugar moiety of the second modified oligonucleotide comprises a 2'-4' bridge selected from —O—CH$_2$—; and —O—CH(CH$_3$)—.

Embodiment 183. The oligomeric duplex of embodiment 182, wherein the modified sugar moiety of the second modified oligonucleotide comprises a non-bicyclic modified sugar moiety.

Embodiment 184. The oligomeric duplex of embodiment 183, wherein the non-bicyclic modified sugar moiety of the second modified oligonucleotide is a 2'-MOE sugar moiety, a 2'-F sugar moiety, or 2'-OMe sugar moiety.

Embodiment 185. The oligomeric duplex of any of embodiments 174-184, wherein at least one nucleoside of the second modified oligonucleotide comprises a sugar surrogate.

Embodiment 186. The oligomeric duplex of any of embodiments 174-185, wherein at least one internucleoside linkage of the second modified oligonucleotide is a modified internucleoside linkage.

Embodiment 187. The oligomeric duplex of embodiment 186, wherein at least one modified internucleoside linkage of the second modified oligonucleotide is a phosphorothioate internucleoside linkage.

Embodiment 188. The oligomeric duplex of any of embodiments 174-187, wherein at least one internucleoside linkage of the second modified oligonucleotide is a phosphodiester internucleoside linkage.

Embodiment 189. The oligomeric duplex of any of embodiments 174-188, wherein each internucleoside linkage of the second modified oligonucleotide is independently selected from a phosphodiester or a phosphorothioate internucleoside linkage.

Embodiment 190. The oligomeric duplex of any of embodiments 174-189, wherein each internucleoside linkage of the second modified oligonucleotide is independently selected from a phosphodiester internucleoside linkage, a phosphorothioate internucleoside linkage, or a mesyl phosphoramidate internucleoside linkage.

Embodiment 191. The oligomeric duplex of any of embodiments 174-190, wherein the second modified oligonucleotide comprises at least one modified nucleobase.

Embodiment 192. The oligomeric duplex of embodiment 191, wherein the modified nucleobase of the second modified oligonucleotide is 5-methylcytosine.

Embodiment 193. The oligomeric duplex of any of embodiments 174-192, wherein the second modified oligonucleotide comprises a conjugate group.

Embodiment 194. The oligomeric duplex of embodiment 193, wherein the conjugate group comprises a conjugate linker and a conjugate moiety.

Embodiment 195. The oligomeric duplex of embodiment 193 or 194, wherein the conjugate group is attached to the second modified oligonucleotide at the 5'-end of the second modified oligonucleotide.

Embodiment 196. The oligomeric duplex of embodiment 193 or 194, wherein the conjugate group is attached to the second modified oligonucleotide at the 3'-end of the modified oligonucleotide.

Embodiment 197. The oligomeric duplex of any of embodiments 193-196, wherein the second modified oligonucleotide comprises a terminal group.

Embodiment 198. The oligomeric duplex of embodiment 197, wherein the terminal group is an abasic sugar moiety.

Embodiment 199. The oligomeric duplex of any of embodiments 174-198, wherein the second modified oligonucleotide consists of 10 to 25, 10 to 30, 10 to 50, 12 to 20, 12 to 25, 12 to 30, 12 to 50, 13 to 20, 13 to 25, 13 to 30, 13 to 50, 14 to 20, 14 to 25, 14 to 30, 14 to 50, 15 to 20, 15 to 25, 15 to 30, 15 to 50, 16 to 18, 16 to 20, 16 to 25, 16 to 30, 16 to 50, 17 to 20, 17 to 25, 17 to 30, 17 to 50, 18 to 20, 18 to 25, 18 to 30, 18 to 50, 19 to 20, 19 to 25, 19 to 30, 19 to 50, 20 to 25, 20 to 30, 20 to 50, 21 to 25, 21 to 30, 21 to 50, 22 to 25, 22 to 30, 22 to 50, 23 to 25, 23 to 30, or 23 to 50 linked nucleosides.

Embodiment 200. An antisense agent comprising an antisense compound, wherein the antisense compound is the oligomeric compound of any of embodiments 87-154 or the modified oligonucleotide of any of embodiments 155-167.

Embodiment 201. The antisense agent of embodiment 200, wherein the antisense agent is the oligomeric duplex of any of embodiments 174-199.

Embodiment 202. The antisense agent of embodiment 200 or 201, wherein the antisense agent is an RNase H agent capable of reducing the amount of ATXN1 nucleic acid through the activation of RNase H.

Embodiment 203. The antisense agent of any of embodiments 200-202, wherein the conjugate group comprises a cell-targeting moiety.

Embodiment 204. A pharmaceutical composition comprising an oligomeric compound of any of embodiments 87-154, the modified oligonucleotide of any of embodiments 155-167, the population of any of embodiments 168-173, an oligomeric duplex of any of embodiments 174-199, or an antisense agent of any of embodiments 200-203, and a pharmaceutically acceptable carrier or diluent.

Embodiment 205. The pharmaceutical composition of embodiment 204, wherein the pharmaceutically acceptable diluent is water, phosphate-buffered saline, or artificial cerebral spinal fluid.

Embodiment 206. The pharmaceutical composition of embodiment 205, wherein the pharmaceutical composition consists essentially of the modified oligonucleotide and artificial cerebral spinal fluid.

Embodiment 207. A method comprising administering to a subject the oligomeric compound of any of embodiments 87-154, the modified oligonucleotide of any of embodiments 155-167, the population of any of embodiments 168-173, the oligomeric duplex of any of embodiments 174-199, the antisense agent of any of embodiments 200-203, or the pharmaceutical composition of any of embodiments 204-206.

Embodiment 208. A method of treating a disease associated with ATXN1 comprising administering to a subject having a disease associated with ATXN1 a therapeutically effective amount of the oligomeric compound of any of embodiments 87-154, the modified oligonucleotide of any of embodiments 155-167, the population of any of embodiments 168-173, the oligomeric duplex of any of embodiments 174-199, the antisense agent of any of embodiments 200-203, or the pharmaceutical composition of any of embodiments 204-206; thereby treating the disease associated with ATXN1.

Embodiment 209. The method of embodiment 208, wherein the ATXN1-associated disease is Spinocerebellar ataxia type 1.

Embodiment 210. The method of any of embodiments 208-209, wherein at least one symptom or hallmark of the ATXN1-associated disease is ameliorated.

Embodiment 211. The method of embodiment 210, wherein the symptom or hallmark is gait or limb ataxia, cognitive impairments, difficulty with speaking or swallowing, atrophy of the cerebellum and/or brainstem in magnetic resonance imaging (MRI), neurochemical abnormalities in the cerebellum and/or brainstem detected via magnetic resonance spectroscopy (MRS), or death within 10-15 years of symptom onset.

Embodiment 212. The method of any of embodiments 208-211, wherein ATXN1 levels in the subject are reduced.

Embodiment 213. A method of reducing expression of ATXN1 in a cell comprising contacting the cell with the oligomeric compound of any of embodiments 87-154, the modified oligonucleotide of any of embodiments 155-167, the population of any of embodiments 168-173, the oligomeric duplex of any of embodiments 174-199, the antisense agent of any of embodiments 200-203, or the pharmaceutical composition of any of embodiments 204-206.

Embodiment 214. The method of embodiment 213, wherein the cell is a CNS cell.

Embodiment 215. Use of the oligomeric compound of any of embodiments 87-154, the modified oligonucleotide of any of embodiments 155-167, the population of any of embodiments 168-173, the oligomeric duplex of any of embodiments 174-199, the antisense agent of any of embodiments 200-203, or the pharmaceutical composition of any of embodiments 204-206 for treating a disease associated with ATXN1.

Embodiment 216. Use of the oligomeric compound of any of embodiments 87-154, the modified oligonucleotide of any of embodiments 155-167, the population of any of embodiments 168-173, the oligomeric duplex of any of embodiments 174-199, the antisense agent of any of embodiments 200-203, or the pharmaceutical composition of any of embodiments 204-206 in the manufacture of a medicament for treating a disease associated with ATXN1.

Embodiment 217. The use of embodiment 215 or 216, wherein the disease associated with ATXN1 is Spinocerebellar ataxia type 1.

I. Certain Oligonucleotides

In certain embodiments, provided herein are oligomeric compounds comprising oligonucleotides, which consist of linked nucleosides. Oligonucleotides may be unmodified oligonucleotides (RNA or DNA) or may be modified oligonucleotides. Modified oligonucleotides comprise at least one modification relative to unmodified RNA or DNA. That is, modified oligonucleotides comprise at least one modified nucleoside (comprising a modified sugar moiety and/or a modified nucleobase) and/or at least one modified internucleoside linkage.

A. Certain Modified Nucleosides

Modified nucleosides comprise a modified sugar moiety or a modified nucleobase or both a modified sugar moiety and a modified nucleobase.

1. Certain Sugar Moieties

In certain embodiments, modified sugar moieties are non-bicyclic modified sugar moieties. In certain embodiments, modified sugar moieties are bicyclic or tricyclic sugar moieties. In certain embodiments, modified sugar moieties are sugar surrogates. Such sugar surrogates may comprise one or more substitutions corresponding to those of other types of modified sugar moieties.

In certain embodiments, modified sugar moieties are non-bicyclic modified sugar moieties comprising a furanosyl ring with one or more substituent groups none of which bridges two atoms of the furanosyl ring to form a bicyclic structure. Such non bridging substituents may be at any position of the furanosyl, including but not limited to substituents at the 2', 4', and/or 5' positions. In certain embodiments one or more non-bridging substituent of non-bicyclic modified sugar moieties is branched. Examples of 2'-substituent groups suitable for non-bicyclic modified sugar moieties include but are not limited to: 2'-F, 2'-OCH$_3$ ("OMe" or "O-methyl"), and 2'-O(CH$_2$)$_2$OCH$_3$ ("MOE" or "O-methoxyethyl"). In certain embodiments, 2'-substituent groups are selected from among: halo, allyl, amino, azido, SH, CN, OCN, CF$_3$, OCF$_3$, O—C$_1$-C$_{10}$ alkoxy, O—C$_1$-C$_{10}$ substituted alkoxy, O—C$_1$-C$_{10}$ alkyl, O—C$_1$-C$_{10}$ substituted alkyl, S-alkyl, N(R$_m$)-alkyl, O-alkenyl, S-alkenyl, N(R$_m$)-alkenyl, O-alkynyl, S-alkynyl, N(R$_m$)-alkynyl, O-alkylenyl-O-alkyl, alkynyl, alkaryl, aralkyl, O-alkaryl, O-aralkyl, O(CH$_2$)$_2$SCH$_3$, O(CH$_2$)$_2$ON(R$_m$)(R$_n$) or OCH$_2$C(=O)—N(R$_m$)(R$_n$), where each R$_m$ and R$_n$ is, independently, H, an amino protecting group, or substituted or unsubstituted C$_1$-C$_{10}$ alkyl, and the 2'-substituent groups described in Cook et al., U.S. Pat. No. 6,531,584; Cook et al., U.S. Pat. No. 5,859,221; and Cook et al., U.S. Pat. No. 6,005,087. Certain embodiments of these 2'-substituent groups can be further substituted with one or more substituent groups independently selected from among: hydroxyl, amino, alkoxy, carboxy, benzyl, phenyl, nitro (NO$_2$), thiol, thioalkoxy, thioalkyl, halogen, alkyl, aryl, alkenyl and alkynyl. Examples of 4'-substituent groups suitable for non-bicyclic modified sugar moieties include but are not limited to alkoxy (e.g., methoxy), alkyl, and those described in Manoharan et al., WO 2015/106128. Examples of 5'-substituent groups suitable for non-bicyclic modified sugar moieties include but are not limited to: 5-methyl (R or S), 5'-vinyl, and 5'-methoxy. In certain embodiments, non-bicyclic modified sugar moieties comprise more than one non-bridging sugar substituent, for example, 2'-F-5'-methyl sugar moieties and the modified sugar moieties and modified nucleosides described in Migawa et al., WO 2008/101157 and Rajeev et al., US2013/0203836.

In certain embodiments, a 2'-substituted non-bicyclic modified nucleoside comprises a sugar moiety comprising a non-bridging 2'-substituent group selected from: F, NH$_2$, N$_3$, OCF$_3$, OCH$_3$, O(CH$_2$)$_3$NH$_2$, CH$_2$CH=CH$_2$, OCH$_2$CH=CH$_2$, OCH$_2$CH$_2$OCH$_3$, O(CH$_2$)$_2$SCH$_3$, O(CH$_2$)$_2$ON(R$_m$)(R$_n$), O(CH$_2$)$_2$O(CH$_2$)$_2$N(CH$_3$)$_2$, and N-substituted acetamide (OCH$_2$C(=O)—N(R$_m$)(R$_n$)), where each R$_m$ and R$_n$ is, independently, H, an amino protecting group, or substituted or unsubstituted C$_1$-C$_{10}$ alkyl.

In certain embodiments, a 2'-substituted nucleoside non-bicyclic modified nucleoside comprises a sugar moiety comprising a non-bridging 2'-substituent group selected from: F, OCF$_3$, OCH$_3$, OCH$_2$CH$_2$OCH$_3$, O(CH$_2$)$_2$SCH$_3$, O(CH$_2$)$_2$ON(CH$_3$)$_2$, O(CH$_2$)$_2$O(CH$_2$)$_2$N(CH$_3$)$_2$, and OCH$_2$C(=O)—N(H)CH$_3$ ("NMA").

In certain embodiments, a 2'-substituted nucleoside comprises a sugar moiety comprising a non-bridging 2'-substituent group selected from: F, OCH$_3$, and OCH$_2$CH$_2$OCH$_3$.

In certain embodiments, modified furanosyl sugar moieties and nucleosides incorporating such modified furanosyl sugar moieties are further defined by isomeric configuration. For example, a 2'-deoxyfuranosyl sugar moiety may be in seven isomeric configurations other than the naturally occurring β-D-deoxyribosyl configuration. Such modified sugar moieties are described in, e.g., WO 2019/157531, incorporated by reference herein. A 2'-modified sugar moiety has an additional stereocenter at the 2'-position relative to a 2'-deoxyfuranosyl sugar moiety; therefore, such sugar moieties have a total of sixteen possible isomeric configurations. 2'-modified sugar moieties described herein are in the β-D-ribosyl isomeric configuration unless otherwise specified.

Certain modified sugar moieties comprise a substituent that bridges two atoms of the furanosyl ring to form a second ring, resulting in a bicyclic sugar moiety. In certain such embodiments, the bicyclic sugar moiety comprises a bridge between the 4' and the 2' furanose ring atoms. Examples of such 4' to 2' bridging sugar substituents include but are not limited to: 4'-CH$_2$-2', 4'-(CH$_2$)$_2$-2', 4'-(CH$_2$)$_3$-2', 4'-CH$_2$—O-2' ("LNA"), 4'-CH$_2$—S-2', 4'-(CH$_2$)$_2$-O-2' ("ENA"), 4'-CH(CH$_3$)—O-2' (referred to as "constrained ethyl" or "cEt"), 4'-CH$_2$—O—CH$_2$-2', 4'-CH$_2$—N(R)-2', 4'-CH(CH$_2$OCH$_3$)—O-2' ("constrained MOE" or "cMOE") and analogs thereof (see, e.g., Seth et al., U.S. Pat. No. 7,399,845, Bhat et al., U.S. Pat. No. 7,569,686, Swayze et al., U.S. Pat. No. 7,741,457, and Swayze et al., U.S. Pat. No. 8,022,193), 4'-C(CH$_3$)(CH$_3$)—O-2' and analogs thereof (see, e.g., Seth et al., U.S. Pat. No. 8,278,283), 4'-CH$_2$—N(OCH$_3$)-2' and analogs thereof (see, e.g., Prakash et al., U.S. Pat. No. 8,278,425), 4'-CH$_2$—O—N(CH$_3$)-2' (see, e.g., Allerson et al., U.S. Pat. No. 7,696,345 and Allerson et al., U.S. Pat. No. 8,124,745), 4'-CH$_2$—C(H)(CH$_3$)-2' (see, e.g., Zhou, et al., J. Org. Chem., 2009, 74, 118-134), 4'-CH$_2$—C(=CH$_2$)-2' and analogs thereof (see e.g., Seth et al., U.S. Pat. No. 8,278, 426), 4'-C(R$_a$R$_b$)—N(R)—O-2', 4'-C(R$_a$R$_b$)—O—N(R)-2', 4'-CH$_2$—O—N(R)-2', and 4'-CH$_2$—N(R)—O- 2', wherein each R, R$_a$, and R$_b$ is, independently, H, a protecting group, or C$_1$-C$_{12}$ alkyl (see, e.g. Imanishi et al., U.S. Pat. No. 7,427,672).

In certain embodiments, such 4' to 2' bridges independently comprise from 1 to 4 linked groups independently selected from: —[C(R$_a$)(R$_b$)]$_n$—, —[C(R$_a$)(R$_b$)]$_n$—O—, —C(R$_a$)=C(R$_b$)—, —C(R$_a$)=N—, —C(=NR$_a$)—, —C(=O)—, —C(=S)—, —O—, —Si(R$_a$)$_2$-, —S(=O)$_x$—, and —N(R$_a$)—;

wherein:

x is 0, 1, or 2;

n is 1, 2, 3, or 4;

each R$_a$ and R$_b$ is, independently, H, a protecting group, hydroxyl, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, heterocycle radical, substituted heterocycle radical, heteroaryl, substituted heteroaryl, C$_5$-C$_7$ alicyclic radical, substituted C$_5$-C$_7$ alicyclic radical, halogen, OJ$_1$, NJ$_1$J$_2$, SJ$_1$, N$_3$, COOJ$_1$, acyl (C(=O)—H), substituted acyl, CN, sulfonyl (S(=O)$_2$-J$_1$), or sulfoxyl (S(=O)-J$_1$); and each J$_1$ and J$_2$ is, independently, H, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, acyl (C(=O)—H), substituted acyl, a heterocycle radical, a substituted heterocycle radical, C$_1$-C$_{12}$ aminoalkyl, substituted C$_1$-C$_{12}$ aminoalkyl, or a protecting group.

Additional bicyclic sugar moieties are known in the art, see, for example: Freier et al., Nucleic Acids Research, 1997, 25(22), 4429-4443, Albaek et al., J. Org. Chem., 2006, 71, 7731-7740, Singh et al., Chem. Commun., 1998, 4, 455-456; Koshkin et al., Tetrahedron, 1998, 54, 3607-3630; Kumar et al., Bioorg. Med. Chem. Lett., 1998, 8, 2219-2222; Singh et al., J. Org. Chem., 1998, 63, 10035-10039; Srivastava et al., J. Am. Chem. Soc., 2007, 129, 8362-8379; Wengel et al., U.S. Pat. No. 7,053,207; Imanishi et al., U.S. Pat. No. 6,268,490; Imanishi et al. U.S. Pat. No. 6,770,748; Imanishi et al., U.S. RE44,779; Wengel et al., U.S. Pat. No. 6,794, 499; Wengel et al., U.S. Pat. No. 6,670,461; Wengel et al., U.S. Pat. No. 7,034,133; Wengel et al., U.S. Pat. No. 8,080,644; Wengel et al., U.S. Pat. No. 8,034,909; Wengel et al., U.S. Pat. No. 8,153,365; Wengel et al., U.S. Pat. No. 7,572,582; Ramasamy et al., U.S. Pat. No. 6,525,191; Torsten et al., WO 2004/106356; Wengel et al., WO 1999/014226; Seth et al., WO 2007/134181; Seth et al., U.S. Pat. No. 7,547,684; Seth et al., U.S. Pat. No. 7,666,854; Seth et al., U.S. Pat. No. 8,088,746; Seth et al., U.S. Pat. No. 7,750,131; Seth et al., U.S. Pat. No. 8,030,467; Seth et al., U.S. Pat. No. 8,268,980; Seth et al., U.S. Pat. No. 8,546,556; Seth et al., U.S. Pat. No. 8,530,640; Migawa et al., U.S. Pat. No. 9,012,421; Seth et al., U.S. Pat. No. 8,501,805; and U.S. Patent Publication Nos. Allerson et al., US2008/0039618 and Migawa et al., US2015/0191727.

In certain embodiments, bicyclic sugar moieties and nucleosides incorporating such bicyclic sugar moieties are further defined by isomeric configuration. For example, an LNA nucleoside (described herein) may be in the α-L configuration or in the β-D configuration.

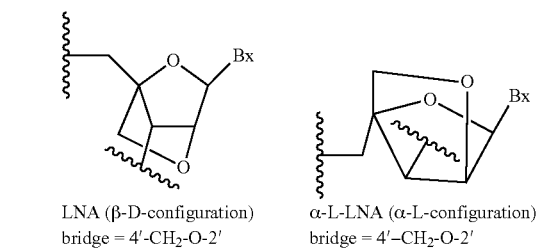

LNA (β-D-configuration)
bridge = 4'-CH$_2$-O-2'

α-L-LNA (α-L-configuration)
bridge = 4'–CH$_2$-O-2'

α-L-methyleneoxy (4'-CH$_2$—O-2') or α-L-LNA bicyclic nucleosides have been incorporated into oligonucleotides that showed antisense activity (Frieden et al., Nucleic Acids Research, 2003, 21, 6365-6372). Herein, general descriptions of bicyclic nucleosides include both isomeric configurations. When the positions of specific bicyclic nucleosides (e.g., LNA or cEt) are identified in exemplified embodiments herein, they are in the β-D configuration, unless otherwise specified.

In certain embodiments, modified sugar moieties comprise one or more non-bridging sugar substituent and one or more bridging sugar substituent (e.g., 5'-substituted and 4'-2' bridged sugars).

In certain embodiments, modified sugar moieties are sugar surrogates. In certain such embodiments, the oxygen atom of the sugar moiety is replaced, e.g., with a sulfur, carbon or nitrogen atom. In certain such embodiments, such modified sugar moieties also comprise bridging and/or non-bridging substituents as described herein. For example, certain sugar surrogates comprise a 4'-sulfur atom and a substitution at the 2'-position (see, e.g., Bhat et al., U.S. Pat. No. 7,875,733 and Bhat et al., U.S. Pat. No. 7,939,677) and/or the 5' position.

In certain embodiments, sugar surrogates comprise rings having other than 5 atoms. For example, in certain embodiments, a sugar surrogate comprises a six-membered tetrahydropyran ("THP"). Such tetrahydropyrans may be further modified or substituted. Nucleosides comprising such modified tetrahydropyrans include but are not limited to hexitol nucleic acid ("HNA"), anitol nucleic acid ("ANA"), manitol nucleic acid ("NINA") (see, e.g., Leumann, C J. Bioorg. & Med. Chem. 2002, 10, 841-854), fluoro HNA:

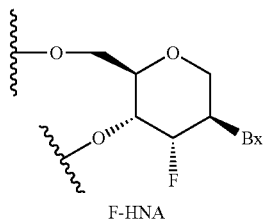

F-HNA ("F-HNA", see e.g. Swayze et al., U.S. Pat. No. 8,088,904; Swayze et al., U.S. Pat. No. 8,440,803; Swayze et al., U.S. Pat. No. 8,796,437; and Swayze et al., U.S. Pat. No. 9,005, 906; F-HNA can also be referred to as a F-THP or 3'-fluoro tetrahydropyran), and nucleosides comprising additional modified THP compounds having the formula:

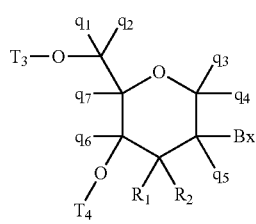

wherein, independently, for each of the modified THP nucleosides:

Bx is a nucleobase moiety;

$T_3$ and $T_4$ are each, independently, an internucleoside linking group linking the modified THP nucleoside to the remainder of an oligonucleotide or one of $T_3$ and $T_4$ is an internucleoside linking group linking the modified THP nucleoside to the remainder of an oligonucleotide and the other of $T_3$ and $T_4$ is H, a hydroxyl protecting group, a linked conjugate group, or a 5' or 3'-terminal group;

$q_1$, $q_2$, $q_3$, $q_4$, $q_5$, $q_6$ and q are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, or substituted $C_2$-$C_6$ alkynyl; and each of $R_1$ and $R_2$ is independently selected from among: hydrogen, halogen, substituted or unsubstituted alkoxy, $NJ_1J_2$, $SJ_1$, $N_3$, $OC(=X)J_1$, $OC(=X)NJ_1J_2$, $NJ_3C(=X)NJ_1J_2$, and CN, wherein X is O, S or $NJ_1$, and each $J_1$, $J_2$, and $J_3$ is, independently, H or $C_1$-$C_6$ alkyl.

In certain embodiments, modified THP nucleosides are provided wherein $q_1$, $q_2$, $q_3$, $q_4$, $q_5$, $q_6$ and $q_7$ are each H. In certain embodiments, at least one of $q_1$, $q_2$, $q_3$, $q_4$, $q_5$, $q_6$ and $q_7$ is other than H. In certain embodiments, at least one of $q_1$, $q_2$, $q_3$, $q_4$, $q_5$, $q_6$ and $q_7$ is methyl. In certain embodiments, modified THP nucleosides are provided wherein one of $R_1$ and $R_2$ is F. In certain embodiments, $R_1$ is F and $R_2$ is H, in certain embodiments, $R_1$ is methoxy and $R_2$ is H, and in certain embodiments, $R_1$ is methoxyethoxy and $R_2$ is H.

In certain embodiments, sugar surrogates comprise rings having more than 5 atoms and more than one heteroatom. For example, nucleosides comprising morpholino sugar moieties and their use in oligonucleotides have been reported (see, e.g., Braasch et al., Biochemistry, 2002, 41, 4503-4510 and Summerton et al., U.S. Pat. No. 5,698,685; Summerton et al., U.S. Pat. No. 5,166,315; Summerton et al., U.S. Pat. No. 5,185,444; and Summerton et al., U.S. Pat. No. 5,034,506). As used here, the term "morpholino" means a sugar surrogate having the following structure:

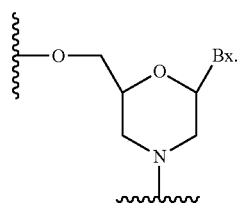

In certain embodiments, morpholinos may be modified, for example by adding or altering various substituent groups from the above morpholino structure. Such sugar surrogates are referred to herein as "modified morpholinos."

In certain embodiments, sugar surrogates comprise acyclic moieties. Examples of nucleosides and oligonucleotides comprising such acyclic sugar surrogates include but are not limited to: peptide nucleic acid ("PNA"), acyclic butyl nucleic acid (see, e.g., Kumar et al., Org. Biomol. Chem., 2013, 11, 5853-5865), and nucleosides and oligonucleotides described in Manoharan et al., WO2011/133876.

Many other bicyclic and tricyclic sugar and sugar surrogate ring systems are known in the art that can be used in modified nucleosides.

2. Certain Modified Nucleobases

In certain embodiments, modified oligonucleotides comprise one or more nucleosides comprising an unmodified nucleobase. In certain embodiments, modified oligonucleotides comprise one or more nucleoside comprising a modified nucleobase. In certain embodiments, modified oligonucleotides comprise one or more nucleoside that does not comprise a nucleobase, referred to as an abasic nucleoside.

In certain embodiments, modified nucleobases are selected from: 5-substituted pyrimidines, 6-azapyrimidines, alkyl or alkynyl substituted pyrimidines, alkyl substituted purines, and N-2, N-6 and 0-6 substituted purines. In certain embodiments, modified nucleobases are selected from: 2-aminopropyladenine, 5-hydroxymethyl cytosine, xanthine, hypoxanthine, 2-aminoadenine, 6-N-methylguanine, 6-N-methyladenine, 2-propyladenine, 2-thiouracil, 2-thiothymine and 2-thiocytosine, 5-propynyl (—C≡C—$CH_3$) uracil, 5-propynylcytosine, 6-azouracil, 6-azocytosine, 6-azothymine, 5-ribosyluracil (pseudouracil), 4-thiouracil, 8-halo, 8-amino, 8-thiol, 8-thioalkyl, 8-hydroxyl, 8-aza and other 8-substituted purines, 5-halo, particularly 5-bromo, 5-trifluoromethyl, 5-halouracil, and 5-halocytosine, 7-methylguanine, 7-methyladenine, 2-F-adenine, 2-aminoadenine, 7-deazaguanine, 7-deazaadenine, 3-deazaguanine, 3-deazaadenine, 6-N-benzoyladenine, 2-N-isobutyrylguanine, 4-N-benzoylcytosine, 4-N-benzoyluracil, 5-methyl 4-N-benzoylcytosine, 5-methyl 4-N-benzoyluracil, universal bases, hydrophobic bases, promiscuous bases, size-expanded bases, and fluorinated bases. Further modified nucleobases include tricyclic pyrimidines, such as 1,3-diazaphenoxazine-2-one, 1,3-diazaphenothiazine-2-one and 9-(2-aminoethoxy)-1,3-diazaphenoxazine-2-one (G-clamp). Modified nucleobases may also include those in which the purine or pyrimidine base is replaced with other heterocycles, for example 7-deazaadenine, 7-deazaguanosine, 2-aminopyridine and 2-pyridone. Further nucleobases include those disclosed in Merigan et al., U.S. Pat. No. 3,687,808, those disclosed in *The Concise Encyclopedia Of Polymer Science And Engineering*, Kroschwitz, J. I., Ed., John Wiley & Sons, 1990, 858-859; Englisch et al., *Angewandte Chemie*, International Edition, 1991, 30, 613; Sanghvi, Y. S., Chapter 15, *Antisense Research and Applications*, Crooke, S. T. and Lebleu, B., Eds., CRC Press, 1993, 273-288; and those disclosed in Chapters 6 and 15, *Antisense Drug Technology*, Crooke S. T., Ed., CRC Press, 2008, 163-166 and 442-443.

Publications that teach the preparation of certain of the above noted modified nucleobases as well as other modified nucleobases include without limitation, Manoharan et al., US2003/0158403; Manoharan et al., US2003/0175906; Dinh et al., U.S. Pat. No. 4,845,205; Spielvogel et al., U.S. Pat. No. 5,130,302; Rogers et al., U.S. Pat. No. 5,134,066; Bischofberger et al., U.S. Pat. No. 5,175,273; Urdea et al., U.S. Pat. No. 5,367,066; Benner et al., U.S. Pat. No. 5,432,272; Matteucci et al., U.S. Pat. No. 5,434,257; Gmeiner et al., U.S. Pat. No. 5,457,187; Cook et al., U.S. Pat. No. 5,459,255; Froehler et al., U.S. Pat. No. 5,484,908; Matteucci et al., U.S. Pat. No. 5,502,177; Hawkins et al., U.S. Pat. No. 5,525,711; Haralambidis et al., U.S. Pat. No. 5,552,540; Cook et al., U.S. Pat. No. 5,587,469; Froehler et al., U.S. Pat. No. 5,594,121; Switzer et al., U.S. Pat. No. 5,596,091; Cook et al., U.S. Pat. No. 5,614,617; Froehler et al., U.S. Pat. No. 5,645,985; Cook et al., U.S. Pat. No. 5,681,941; Cook et al., U.S. Pat. No. 5,811,534; Cook et al., U.S. Pat. No. 5,750,692; Cook et al., U.S. Pat. No. 5,948,903; Cook et al., U.S. Pat. No. 5,587,470; Cook et al., U.S. Pat. No. 5,457,191; Matteucci et al., U.S. Pat. No. 5,763,588; Froehler et al., U.S. Pat. No. 5,830,653; Cook et al., U.S. Pat. No. 5,808,027; Cook et al., 6,166,199; and Matteucci et al., U.S. Pat. No. 6,005,096.

3. Certain Modified Internucleoside Linkages

In certain embodiments, nucleosides of modified oligonucleotides may be linked together using any internucleoside linkage. The two main classes of internucleoside linking groups are defined by the presence or absence of a phosphorus atom. Representative phosphorus-containing internucleoside linkages include but are not limited to phosphodiesters, which contain a phosphodiester bond ("P(O₂)=O") (also referred to as unmodified or naturally occurring linkages), phosphotriesters, methylphosphonates, phosphoramidates, and phosphorothioates ("P(O₂)=S"), and phosphorodithioates ("HS-P=S"). Representative non-phosphorus containing internucleoside linking groups include but are not limited to methylenemethylimino (—CH₂—N(CH₃)—O—CH₂—), thiodiester, thionocarbamate (—O—C(=O)(NH)—S—); siloxane (—O—SiH₂—O—); and N,N'-dimethylhydrazine (—CH₂—N(CH₃)—N(CH₃)—). Modified internucleoside linkages, compared to naturally occurring phosphodiester internucleoside linkages, can be used to alter, typically increase, nuclease resistance of the oligonucleotide. In certain embodiments, internucleoside linkages having a chiral atom can be prepared as a racemic mixture, or as separate enantiomers. Methods of preparation of phosphorous-containing and non-phosphorous-containing internucleoside linkages are well known to those skilled in the art.

Representative internucleoside linkages having a chiral center include but are not limited to alkylphosphonates and phosphorothioates. Modified oligonucleotides comprising internucleoside linkages having a chiral center can be prepared as populations of modified oligonucleotides comprising stereorandom internucleoside linkages, or as populations of modified oligonucleotides comprising phosphorothioate linkages in particular stereochemical configurations. In certain embodiments, populations of modified oligonucleotides comprise phosphorothioate internucleoside linkages wherein all of the phosphorothioate internucleoside linkages are stereorandom. Such modified oligonucleotides can be generated using synthetic methods that result in random selection of the stereochemical configuration of each phosphorothioate linkage. Nonetheless, as is well understood by those of skill in the art, each individual phosphorothioate of each individual oligonucleotide molecule has a defined stereoconfiguration. In certain embodiments, populations of modified oligonucleotides are enriched for modified oligonucleotides comprising one or more particular phosphorothioate internucleoside linkage in a particular, independently selected stereochemical configuration. In certain embodiments, the particular configuration of the particular phosphorothioate linkage is present in at least 65% of the molecules in the population. In certain embodiments, the particular configuration of the particular phosphorothioate linkage is present in at least 70% of the molecules in the population. In certain embodiments, the particular configuration of the particular phosphorothioate linkage is present in at least 80% of the molecules in the population. In certain embodiments, the particular configuration of the particular phosphorothioate linkage is present in at least 90% of the molecules in the population. In certain embodiments, the particular configuration of the particular phosphorothioate linkage is present in at least 99% of the molecules in the population. Such chirally enriched populations of modified oligonucleotides can be generated using synthetic methods known in the art, e.g., methods described in Oka et al., *JACS* 125, 8307 (2003), Wan et al. *Nuc. Acid. Res.* 42, 13456 (2014), and WO 2017/015555. In certain embodiments, a population of modified oligonucleotides is enriched for modified oligonucleotides having at least one indicated phosphorothioate in the (Sp) configuration. In certain embodiments, a population of modified oligonucleotides is enriched for modified oligonucleotides having at least one phosphorothioate in the (Rp) configuration. In certain embodiments, modified oligonucleotides comprising (Rp) and/or (Sp) phosphorothioates comprise one or more of the following formulas, respectively, wherein "B" indicates a nucleobase:

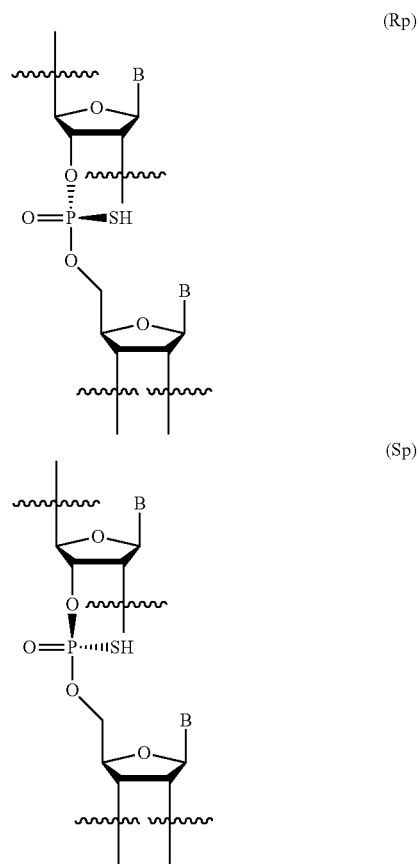

Unless otherwise indicated, chiral internucleoside linkages of modified oligonucleotides described herein can be stereorandom or in a particular stereochemical configuration.

Neutral internucleoside linkages include, without limitation, phosphotriesters, methylphosphonates, MMI (3'-CH₂—N(CH₃)—O-5'), amide-3 (3'-CH₂—C(=O)—N(H)-5'), amide-4 (3'-CH₂—N(H)—C(=O)-5'), formacetal (3'-O—CH₂—O-5'), methoxypropyl (MOP), and thioformacetal (3'-S—CH₂—O-5'). Further neutral internucleoside linkages include nonionic linkages comprising siloxane (dialkylsiloxane), carboxylate ester, carboxamide, sulfide, sulfonate ester and amides (See for example: Carbohydrate Modifications in Antisense Research; Y. S. Sanghvi and P. D. Cook, Eds., ACS Symposium Series 580; Chapters 3 and 4, 40-65). Further neutral internucleoside linkages include nonionic linkages comprising mixed N, O, S and $CH_2$ component parts. In certain embodiments, a neutral internucleoside linkage is any of those described in WO 2021/030778, incorporated by reference herein.

B. Certain Motifs

In certain embodiments, modified oligonucleotides comprise one or more modified nucleosides comprising a modified sugar moiety. In certain embodiments, modified oligonucleotides comprise one or more modified nucleosides comprising a modified nucleobase. In certain embodiments, modified oligonucleotides comprise one or more modified internucleoside linkage. In such embodiments, the modified, unmodified, and differently modified sugar moieties, nucleobases, and/or internucleoside linkages of a modified oligonucleotide define a pattern or motif. In certain embodiments, the patterns of sugar moieties, nucleobases, and internucleoside linkages are each independent of one another. Thus, a modified oligonucleotide may be described by its sugar motif, nucleobase motif and/or internucleoside linkage motif (as used herein, nucleobase motif describes the modifications to the nucleobases independent of the sequence of nucleobases).

1. Certain Sugar Motifs

In certain embodiments, oligonucleotides comprise one or more type of modified sugar and/or unmodified sugar moiety arranged along the oligonucleotide or portion thereof in a defined pattern or sugar motif. In certain instances, such sugar motifs include but are not limited to any of the sugar modifications discussed herein.

In certain embodiments, modified oligonucleotides have a gapmer motif, which is defined by two external regions or "wings" and a central or internal region or "gap." The three regions of a gapmer motif (the 5'-wing, the gap, and the 3'-wing) form a contiguous sequence of nucleosides wherein at least some of the sugar moieties of the nucleosides of each of the wings differ from at least some of the sugar moieties of the nucleosides of the gap. Specifically, at least the sugar moieties of the nucleosides of each wing that are closest to the gap (the 3'-most nucleoside of the 5'-wing and the 5'-most nucleoside of the 3'-wing) differ from the sugar moiety of the neighboring gap nucleosides, thus defining the boundary between the wings and the gap (i.e., the wing/gap junction). In certain embodiments, the sugar moieties within the gap are the same as one another. In certain embodiments, the gap includes one or more nucleoside having a sugar moiety that differs from the sugar moiety of one or more other nucleosides of the gap. In certain embodiments, the sugar motifs of the two wings are the same as one another (symmetric gapmer). In certain embodiments, the sugar motif of the 5'-wing differs from the sugar motif of the 3'-wing (asymmetric gapmer). In certain embodiments, the wings of a gapmer comprise 1-6 nucleosides. In certain embodiments, each nucleoside of each wing of a gapmer comprises a modified sugar moiety. In certain embodiments, at least one nucleoside of each wing of a gapmer comprises a modified sugar moiety. In certain embodiments, at least two nucleosides of each wing of a gapmer comprises a modified sugar moiety. In certain embodiments, at least three nucleosides of each wing of a gapmer comprises a modified sugar moiety. In certain embodiments, at least four nucleosides of each wing of a gapmer comprises a modified sugar moiety. In certain embodiments, at least five nucleosides of each wing of a gapmer comprises a modified sugar moiety.

In certain embodiments, the gap of a gapmer comprises 7-12 nucleosides. In certain embodiments, each nucleoside of the gap of a gapmer comprises a 2'-deoxyribosyl sugar moiety. In certain embodiments, each nucleoside of the gap of a gapmer comprises a 2'-β-D-deoxyribosyl sugar moiety. In certain embodiments, at least one nucleoside of the gap of a gapmer comprises a modified sugar moiety. In certain embodiments, at least one nucleoside of the gap of a gapmer comprises a 2'-OMe sugar moiety.

In certain embodiments, the gapmer is a deoxy gapmer. In certain embodiments, the nucleosides on the gap side of each wing/gap junction comprise 2'-deoxyribosyl sugar moieties and the nucleosides on the wing sides of each wing/gap junction comprise modified sugar moieties. In certain embodiments, each nucleoside of the gap comprises a 2'-deoxyribosyl sugar moiety. In certain embodiments, each nucleoside of each wing of a gapmer comprises a modified sugar moiety. In certain embodiments, one nucleoside of the gap comprises a modified sugar moiety and each remaining nucleoside of the gap comprises a 2'-deoxyribosyl sugar moiety.

In certain embodiments, modified oligonucleotides comprise or consist of a portion having a fully modified sugar motif. In such embodiments, each nucleoside of the fully modified portion of the modified oligonucleotide comprises a modified sugar moiety. In certain embodiments, each nucleoside of the entire modified oligonucleotide comprises a modified sugar moiety. In certain embodiments, modified oligonucleotides comprise or consist of a portion having a fully modified sugar motif, wherein each nucleoside within the fully modified portion comprises the same modified sugar moiety, referred to herein as a uniformly modified sugar motif. In certain embodiments, a fully modified oligonucleotide is a uniformly modified oligonucleotide. In certain embodiments, each nucleoside of a uniformly modified oligonucleotide comprises the same 2'-modification.

Herein, the lengths (number of nucleosides) of the three regions of a gapmer may be provided using the notation [# of nucleosides in the 5'-wing]-[# of nucleosides in the gap]-[# of nucleosides in the 3'-wing]. Thus, a 5-10-5 gapmer consists of 5 linked nucleosides in each wing and 10 linked nucleosides in the gap. Where such nomenclature is followed by a specific modification, that modification is the modification in each sugar moiety of each wing and the gap nucleosides comprises a 2'-β-D-deoxyribosyl sugar moiety. Thus, a 5-10-5 MOE gapmer consists of 5 linked 2'-MOE nucleosides in the 5'-wing, 10 linked a 2'-β-D-deoxynucleosides in the gap, and 5 linked 2'-MOE nucleosides in the 3'-wing. A 3-10-3 cEt gapmer consists of 3 linked cEt nucleosides in the 5'-wing, 10 linked 2'-β-D-deoxynucleosides in the gap, and 3 linked cEt nucleosides in the 3'-wing. A 5-8-5 gapmer consists of 5 linked nucleosides comprising a modified sugar moiety in the 5'-wing, 8 linked a 2'-β-D-deoxynucleosides in the gap, and 5 linked nucleosides comprising a modified sugar moiety in the 3'-wing. A 5-8-5 or 5-8-4 mixed wing gapmer has at least two different modified sugar moieties in the 5'- and/or the 3'-wing.

In certain embodiments, modified oligonucleotides are 5-10-5 MOE gapmers. In certain embodiments, modified oligonucleotides are 6-10-4 MOE gapmers. In certain embodiments, modified oligonucleotides are 5-8-4 MOE gapmers. In certain embodiments, modified oligonucleotides are X-Y-Z MOE gapmers, wherein X and Z are independently selected from 1, 2, 3, 4, 5, 6, or 7 linked 2'-MOE nucleosides and Y is selected from 7, 8, 9, 10, or 11. linked deoxynucleosides.

In certain embodiments, modified oligonucleotides have a sugar motif selected from the following (5' to 3'): eeeeedddddddkkee or eeeeedydddddkkee, wherein 'd' represents a 2'-deoxyribosyl sugar moiety, 'e' represents a 2'-MOE sugar moiety, 'k' represents a cEt sugar moiety, and 'y' represents a 2'-OMe sugar moiety.

2. Certain Nucleobase Motifs

In certain embodiments, oligonucleotides comprise modified and/or unmodified nucleobases arranged along the oligonucleotide or portion thereof in a defined pattern or motif. In certain embodiments, each nucleobase is modified. In certain embodiments, none of the nucleobases are modified. In certain embodiments, each purine or each pyrimidine is modified. In certain embodiments, each adenine is modified. In certain embodiments, each guanine is modified. In certain embodiments, each thymine is modified. In certain embodiments, each uracil is modified. In certain embodiments, each cytosine is modified. In certain embodiments, some or all of the cytosine nucleobases in a modified oligonucleotide are 5-methyl cytosines. In certain embodiments, all of the cytosine nucleobases are 5-methyl cytosines and all of the other nucleobases of the modified oligonucleotide are unmodified nucleobases.

In certain embodiments, modified oligonucleotides comprise a block of modified nucleobases. In certain such embodiments, the block is at the 3'-end of the oligonucleotide. In certain embodiments the block is within 3 nucleosides of the 3'-end of the oligonucleotide. In certain embodiments, the block is at the 5'-end of the oligonucleotide. In certain embodiments the block is within 3 nucleosides of the 5'-end of the oligonucleotide.

In certain embodiments, oligonucleotides having a gapmer motif comprise a nucleoside comprising a modified nucleobase. In certain such embodiments, one nucleoside comprising a modified nucleobase is in the central gap of an oligonucleotide having a gapmer motif. In certain such embodiments, the sugar moiety of said nucleoside is a 2'-deoxyribosyl sugar moiety. In certain embodiments, the modified nucleobase is selected from: a 2-thiopyrimidine and a 5-propynepyrimidine.

3. Certain Internucleoside Linkage Motifs

In certain embodiments, oligonucleotides comprise modified and/or unmodified internucleoside linkages arranged along the oligonucleotide or portion thereof in a defined pattern or motif. In certain embodiments, each internucleoside linking group is a phosphodiester internucleoside linkage ($P(O_2)=O$). In certain embodiments, each internucleoside linking group of a modified oligonucleotide is a phosphorothioate internucleoside linkage ($P(O_2)=S$). In certain embodiments, each internucleoside linkage of a modified oligonucleotide is independently selected from a phosphorothioate internucleoside linkage and phosphodiester internucleoside linkage. In certain embodiments, each phosphorothioate internucleoside linkage is independently selected from a stereorandom phosphorothioate, a (Sp) phosphorothioate, and a (Rp) phosphorothioate. In certain embodiments, the sugar motif of a modified oligonucleotide is a gapmer and the internucleoside linkages within the gap are all modified. In certain such embodiments, some or all of the internucleoside linkages in the wings are unmodified phosphodiester internucleoside linkages. In certain embodiments, the terminal internucleoside linkages are modified. In certain embodiments, the sugar motif of a modified oligonucleotide is a gapmer, and the internucleoside linkage motif comprises at least one phosphodiester internucleoside linkage in at least one wing, wherein the at least one phosphodiester linkage is not a terminal internucleoside linkage, and the remaining internucleoside linkages are phosphorothioate internucleoside linkages. In certain such embodiments, all of the phosphorothioate linkages are stereorandom. In certain embodiments, all of the phosphorothioate linkages in the wings are (Sp) phosphorothioates, and the gap comprises at least one Sp, Sp, Rp motif. In certain embodiments, all of the internucleoside linkages are either phosphodiester internucleoside linkages or phosphorothioate internucleoside linkages, and the chiral motif is (5' to 3'): Sp-o-o-o-Sp-Sp-Sp-Rp-Sp-Sp-Rp-Sp-Sp-Sp-Sp-Sp-Sp-Sp-Sp or Sp-o-o-o-Sp-Sp-Sp-Rp-Sp-Sp-Sp-Sp-Sp-Sp-Sp-Sp-Sp-Sp, wherein each 'Sp' represents a (Sp) phosphorothioate internucleoside linkage, each 'Rp' is a Rp internucleoside linkage, and each 'o' represents a phosphodiester internucleoside linkage. In certain embodiments, populations of modified oligonucleotides are enriched for modified oligonucleotides comprising such internucleoside linkage motifs.

In certain embodiments, modified oligonucleotides have an internucleoside linkage motif of sooossssssssssssooss, wherein each "s" represents a phosphorothioate internucleoside linkage and each "o" represents a phosphodiester internucleoside linkage. In certain embodiments, modified oligonucleotides have an internucleoside linkage motif of (5' to 3'): sooooosssssssssssoss, wherein each "s" represents a phosphorothioate internucleoside linkage and each "o" represents a phosphodiester internucleoside linkage. In certain embodiments, modified oligonucleotides have an internucleoside linkage motif of (5' to 3'): sssosssssssssssosss, wherein each "s" represents a phosphorothioate internucleoside linkage and each "o" represents a phosphodiester internucleoside linkage. In certain embodiments, modified oligonucleotides have an internucleoside linkage motif of (5' to 3'): sssosssssssssoss, wherein each "s" represents a phosphorothioate internucleoside linkage and each "o" represents a phosphodiester internucleoside linkage.

C. Certain Lengths

It is possible to increase or decrease the length of an oligonucleotide without eliminating activity. For example, in Woolf et al. (Proc. Natl. Acad. Sci. USA 89:7305-7309, 1992), a series of oligonucleotides 13-25 nucleobases in length were tested for their ability to induce cleavage of a target nucleic acid in an oocyte injection model. Oligonucleotides 25 nucleobases in length with 8 or 11 mismatch bases near the ends of the oligonucleotides were able to direct specific cleavage of the target nucleic acid, albeit to a lesser extent than the oligonucleotides that contained no mismatches. Similarly, target specific cleavage was achieved using 13 nucleobase oligonucleotides, including those with 1 or 3 mismatches.

In certain embodiments, oligonucleotides (including modified oligonucleotides) can have any of a variety of ranges of lengths. In certain embodiments, oligonucleotides consist of X to Y linked nucleosides, where X represents the fewest number of nucleosides in the range and Y represents the largest number nucleosides in the range. In certain such embodiments, X and Y are each independently selected from 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, and 50; provided that X≤Y. For example, in certain embodiments, oligonucleotides consist of 12 to 13, 12 to 14, 12 to 15, 12 to 16, 12 to 17, 12 to 18, 12 to 19, 12 to 20, 12 to 21, 12 to 22, 12 to 23, 12 to 24, 12 to 25, 12 to 26, 12 to 27, 12 to 28, 12 to 29, 12 to 30, 13 to 14, 13 to 15, 13 to 16, 13 to 17, 13 to 18, 13 to 19, 13 to 20, 13 to 21, 13 to 22, 13 to 23, 13 to 24, 13 to 25, 13 to 26, 13 to 27, 13 to 28, 13 to 29, 13 to 30, 14 to 15, 14 to 16, 14 to 17, 14 to 18, 14 to 19, 14 to 20, 14 to 21, 14 to 22, 14 to 23, 14 to 24, 14 to 25, 14 to 26, 14 to 27, 14 to 28, 14 to 29, 14 to 30, 15 to 16, 15 to 17, 15 to 18, 15 to 19, 15 to 20, 15 to 21, 15 to 22, 15 to 23, 15 to 24, 15 to 25, 15 to 26, 15 to 27, 15 to 28, 15 to 29, 15 to 30, 16 to 17, 16 to 18, 16 to 19, 16 to 20, 16 to 21, 16 to 22, 16 to 23, 16 to 24, 16 to 25, 16 to 26, 16 to 27, 16 to 28, 16 to 29, 16 to 30, 17 to 18, 17 to 19, 17 to 20, 17 to 21, 17 to 22, 17 to 23, 17 to 24, 17 to 25, 17 to 26, 17 to 27, 17 to 28, 17 to 29, 17 to 30, 18 to 19, 18 to 20, 18 to 21, 18 to 22, 18 to 23, 18 to 24, 18 to 25, 18 to 26, 18 to 27, 18 to 28, 18 to 29, 18 to 30, 19 to 20, 19 to 21, 19 to 22, 19 to 23, 19 to 24, 19 to 25, 19 to 26, 19 to 29, 19 to 28, 19 to 29, 19 to 30, 20 to 21, 20 to 22, 20 to 23, 20 to 24, 20 to 25, 20 to 26, 20 to 27, 20 to 28, 20 to 29, 20 to 30, 21 to 22, 21 to 23, 21 to 24, 21 to 25, 21 to 26, 21 to 27, 21 to 28, 21 to 29, 21 to 30, 22 to 23, 22 to 24, 22 to 25, 22 to 26, 22 to 27, 22 to 28, 22 to 29, 22 to 30, 23 to 24, 23 to 25, 23 to 26, 23 to 27, 23 to 28, 23 to 29, 23 to 30, 24 to 25, 24 to 26, 24 to 27, 24 to 28, 24 to 29, 24 to 30, 25 to 26, 25 to 27, 25 to 28, 25 to 29, 25 to 30, 26 to 27, 26 to 28, 26 to 29, 26 to 30, 27 to 28, 27 to 29, 27 to 30, 28 to 29, 28 to 30, or 29 to 30 linked nucleosides.

D. Certain Modified Oligonucleotides

In certain embodiments, the above modifications (sugar, nucleobase, internucleoside linkage) are incorporated into a modified oligonucleotide. In certain embodiments, modified oligonucleotides are characterized by their modification motifs and overall lengths. In certain embodiments, such parameters are each independent of one another. Thus, unless otherwise indicated, each internucleoside linkage of an oligonucleotide having a gapmer sugar motif may be modified or unmodified and may or may not follow the gapmer modification pattern of the sugar modifications. For example, the internucleoside linkages within the wing regions of a sugar gapmer may be the same or different from one another and may be the same or different from the internucleoside linkages of the gap region of the sugar motif. Likewise, such sugar gapmer oligonucleotides may comprise one or more modified nucleobase independent of the gapmer pattern of the sugar modifications. Unless otherwise indicated, all modifications are independent of nucleobase sequence.

E. Certain Populations of Modified Oligonucleotides

Populations of modified oligonucleotides in which all of the modified oligonucleotides of the population have the same molecular formula can be stereorandom populations or chirally enriched populations. All of the chiral centers of all of the modified oligonucleotides are stereorandom in a stereorandom population. In a chirally enriched population, at least one particular chiral center is not stereorandom in the modified oligonucleotides of the population. In certain embodiments, the modified oligonucleotides of a chirally enriched population are enriched for β-D ribosyl sugar moieties, and all of the phosphorothioate internucleoside linkages are stereorandom. In certain embodiments, the modified oligonucleotides of a chirally enriched population are enriched for both β-D ribosyl sugar moieties and at least one, particular phosphorothioate internucleoside linkage in a particular stereochemical configuration.

F. Nucleobase Sequence

In certain embodiments, oligonucleotides (unmodified or modified oligonucleotides) are further described by their nucleobase sequence. In certain embodiments oligonucleotides have a nucleobase sequence that is complementary to a second oligonucleotide or an identified reference nucleic acid, such as a target nucleic acid. In certain such embodiments, a portion of an oligonucleotide has a nucleobase sequence that is complementary to a second oligonucleotide or an identified reference nucleic acid, such as a target nucleic acid. In certain embodiments, the nucleobase sequence of a portion or entire length of an oligonucleotide is at least 50%, at least 60%, at least 70%, at least 80%, at least 85%, at least 90%, at least 95%, or 100% complementary to the second oligonucleotide or nucleic acid, such as a target nucleic acid.

II. Certain Oligomeric Compounds

In certain embodiments, provided herein are oligomeric compounds, which consist of an oligonucleotide (modified or unmodified) and optionally one or more conjugate groups and/or terminal groups. Conjugate groups consist of one or more conjugate moiety and a conjugate linker which links the conjugate moiety to the oligonucleotide. Conjugate groups may be attached to either or both ends of an oligonucleotide and/or at any internal position. In certain embodiments, conjugate groups are attached to the 2'-position of a nucleoside of a modified oligonucleotide. In certain embodiments, conjugate groups that are attached to either or both ends of an oligonucleotide are terminal groups. In certain such embodiments, conjugate groups or terminal groups are attached at the 3' and/or 5'-end of oligonucleotides. In certain such embodiments, conjugate groups (or terminal groups) are attached at the 3'-end of oligonucleotides. In certain embodiments, conjugate groups are attached near the 3'-end of oligonucleotides. In certain embodiments, conjugate groups (or terminal groups) are attached at the 5'-end of oligonucleotides. In certain embodiments, conjugate groups are attached near the 5'-end of oligonucleotides.

Examples of terminal groups include but are not limited to conjugate groups, capping groups, phosphate moieties, protecting groups, modified or unmodified nucleosides, and two or more nucleosides that are independently modified or unmodified.

A. Certain Conjugate Groups

In certain embodiments, oligonucleotides are covalently attached to one or more conjugate groups. In certain embodiments, conjugate groups modify one or more properties of the attached oligonucleotide, including but not limited to pharmacodynamics, pharmacokinetics, stability, binding, absorption, tissue distribution, cellular distribution, cellular uptake, charge and clearance. In certain embodiments, conjugate groups impart a new property on the attached oligonucleotide, e.g., fluorophores or reporter groups that enable detection of the oligonucleotide. Certain conjugate groups and conjugate moieties have been described previously, for example: cholesterol moiety (Letsinger et al., Proc. Natl. Acad. Sci. USA, 1989, 86, 6553-6556), cholic acid (Manoharan et al., *Bioorg. Med. Chem. Lett.,* 1994, 4, 1053-1060), a thioether, e.g., hexyl-S-tritylthiol (Manoharan et al., *Ann. N.Y. Acad. Sci.,* 1992, 660, 306-309; Manoharan et al., *Bioorg. Med. Chem. Lett.,* 1993, 3, 2765-2770), a thiocholesterol (Oberhauser et al., *Nucl. Acids Res.,* 1992, 20, 533-538), an aliphatic chain, e.g., do-decan-diol or undecyl residues (Saison-Behmoaras et al., *EMBO J.,* 1991, 10, 1111-1118; Kabanov et al., *FEBS Lett.,* 1990, 259, 327-330; Svinarchuk et al., *Biochimie,* 1993, 75, 49-54), a phospholipid, e.g., di-hexadecyl-rac-glycerol or triethyl-ammonium 1,2-di-O-hexadecyl-rac-glycero-3-H-phosphonate (Manoharan et al., *Tetrahedron Lett.,* 1995, 36, 3651-3654; Shea et al., *Nucl. Acids Res.,* 1990, 18, 3777-3783), a polyamine or a polyethylene glycol chain (Manoharan et al., *Nucleosides & Nucleotides,* 1995, 14, 969-973), or adamantane acetic acid a palmityl moiety (Mishra et al., *Biochim. Biophys. Acta,* 1995, 1264, 229-237), an octadecylamine or hexylamino-carbonyl-oxycholesterol moiety (Crooke et al., *J. Pharmacol. Exp. Ther.,* 1996, 277, 923-937), a tocopherol group (Nishina et al., *Molecular Therapy Nucleic Acids*, 2015, 4, e220; and Nishina et al., *Molecular Therapy*, 2008, 16, 734-740), or a GalNAc cluster (e.g., WO2014/179620).

1. Conjugate Moieties

Conjugate moieties include, without limitation, intercalators, reporter molecules, polyamines, polyamides, peptides, carbohydrates, vitamin moieties, polyethylene glycols, thioethers, polyethers, cholesterols, thiocholesterols, cholic acid moieties, folate, lipids, lipophilic groups, phospholipids, biotin, phenazine, phenanthridine, anthraquinone, adamantane, acridine, fluoresceins, rhodamines, coumarins, fluorophores, and dyes.

In certain embodiments, a conjugate moiety comprises an active drug substance, for example, aspirin, warfarin, phenylbutazone, ibuprofen, suprofen, fen-bufen, ketoprofen, (S)-(+)-pranoprofen, carprofen, dansylsarcosine, 2,3,5-triiodobenzoic acid, fingolimod, flufenamic acid, folinic acid, a benzothiadiazide, chlorothiazide, a diazepine, indomethicin, a barbiturate, a cephalosporin, a sulfa drug, an antidiabetic, an antibacterial or an antibiotic.

2. Conjugate Linkers

Conjugate moieties are attached to oligonucleotides through conjugate linkers. In certain oligomeric compounds, the conjugate linker is a single chemical bond (i.e., the conjugate moiety is attached directly to an oligonucleotide through a single bond). In certain embodiments, the conjugate linker comprises a chain structure, such as a hydrocarbyl chain, or an oligomer of repeating units such as ethylene glycol, nucleosides, or amino acid units.

In certain embodiments, a conjugate linker comprises one or more groups selected from alkyl, amino, oxo, amide, disulfide, polyethylene glycol, ether, thioether, and hydroxylamino. In certain such embodiments, the conjugate linker comprises groups selected from alkyl, amino, oxo, amide and ether groups. In certain embodiments, the conjugate linker comprises groups selected from alkyl and amide groups. In certain embodiments, the conjugate linker comprises groups selected from alkyl and ether groups. In certain embodiments, the conjugate linker comprises at least one phosphorus moiety. In certain embodiments, the conjugate linker comprises at least one phosphate group. In certain embodiments, the conjugate linker includes at least one neutral linking group.

In certain embodiments, conjugate linkers, including the conjugate linkers described above, are bifunctional linking moieties, e.g., those known in the art to be useful for attaching conjugate groups to parent compounds, such as the oligonucleotides provided herein. In general, a bifunctional linking moiety comprises at least two functional groups. One of the functional groups is selected to bind to a particular site on a parent compound and the other is selected to bind to a conjugate group. Examples of functional groups used in a bifunctional linking moiety include but are not limited to electrophiles for reacting with nucleophilic groups and nucleophiles for reacting with electrophilic groups. In certain embodiments, bifunctional linking moieties comprise one or more groups selected from amino, hydroxyl, carboxylic acid, thiol, alkyl, alkenyl, and alkynyl.

Examples of conjugate linkers include but are not limited to pyrrolidine, 8-amino-3,6-dioxaoctanoic acid (ADO), succinimidyl 4-(N-maleimidomethyl) cyclohexane-1-carboxylate (SMCC) and 6-aminohexanoic acid (AHEX or AHA). Other conjugate linkers include but are not limited to substituted or unsubstituted $C_1$-$C_{10}$ alkyl, substituted or unsubstituted $C_2$-$C_{10}$ alkenyl or substituted or unsubstituted $C_2$-$C_{10}$ alkynyl, wherein a nonlimiting list of preferred substituent groups includes hydroxyl, amino, alkoxy, carboxy, benzyl, phenyl, nitro, thiol, thioalkoxy, halogen, alkyl, aryl, alkenyl and alkynyl.

In certain embodiments, conjugate linkers comprise 1-10 linker-nucleosides. In certain embodiments, conjugate linkers comprise 2-5 linker-nucleosides. In certain embodiments, conjugate linkers comprise exactly 3 linker-nucleosides. In certain embodiments, conjugate linkers comprise the TCA motif. In certain embodiments, such linker-nucleosides are modified nucleosides. In certain embodiments such linker-nucleosides comprise a modified sugar moiety. In certain embodiments, linker-nucleosides are unmodified. In certain embodiments, linker-nucleosides comprise an optionally protected heterocyclic base selected from a purine, substituted purine, pyrimidine or substituted pyrimidine. In certain embodiments, a cleavable moiety is a nucleoside selected from uracil, thymine, cytosine, 4-N-benzoylcytosine, 5-methyl cytosine, 4-N-benzoyl-5-methyl cytosine, adenine, 6-N-benzoyladenine, guanine and 2-N-isobutyrylguanine. It is typically desirable for linker-nucleosides to be cleaved from the oligomeric compound after it reaches a target tissue. Accordingly, linker-nucleosides are typically linked to one another and to the remainder of the oligomeric compound through cleavable bonds. In certain embodiments, such cleavable bonds are phosphodiester bonds.

Herein, linker-nucleosides are not considered to be part of the oligonucleotide. Accordingly, in embodiments in which an oligomeric compound comprises an oligonucleotide consisting of a specified number or range of linked nucleosides and/or a specified percent complementarity to a reference nucleic acid and the oligomeric compound also comprises a conjugate group comprising a conjugate linker comprising linker-nucleosides, those linker-nucleosides are not counted toward the length of the oligonucleotide and are not used in determining the percent complementarity of the oligonucleotide for the reference nucleic acid. For example, an oligomeric compound may comprise (1) a modified oligonucleotide consisting of 8-30 nucleosides and (2) a conjugate group comprising 1-10 linker-nucleosides that are contiguous with the nucleosides of the modified oligonucleotide. The total number of contiguous linked nucleosides in such an oligomeric compound is more than 30. Alternatively, an oligomeric compound may comprise a modified oligonucleotide consisting of 8-30 nucleosides and no conjugate group. The total number of contiguous linked nucleosides in such an oligomeric compound is no more than 30. Unless otherwise indicated conjugate linkers comprise no more than 10 linker-nucleosides. In certain embodiments, conjugate linkers comprise no more than 5 linker-nucleosides. In certain embodiments, conjugate linkers comprise no more than 3 linker-nucleosides. In certain embodiments, conjugate linkers comprise no more than 2 linker-nucleosides. In certain embodiments, conjugate linkers comprise no more than 1 linker-nucleoside.

In certain embodiments, it is desirable for a conjugate group to be cleaved from the oligonucleotide. For example, in certain circumstances oligomeric compounds comprising a particular conjugate moiety are better taken up by a particular cell type, but once the oligomeric compound has been taken up, it is desirable that the conjugate group be cleaved to release the unconjugated or parent oligonucleotide. Thus, certain conjugate linkers may comprise one or more cleavable moieties. In certain embodiments, a cleavable moiety is a cleavable bond. In certain embodiments, a cleavable moiety is a group of atoms comprising at least one cleavable bond. In certain embodiments, a cleavable moiety comprises a group of atoms having one, two, three, four, or more than four cleavable bonds. In certain embodiments, a cleavable moiety is selectively cleaved inside a cell or subcellular compartment, such as a lysosome. In certain embodiments, a cleavable moiety is selectively cleaved by endogenous enzymes, such as nucleases.

In certain embodiments, a cleavable bond is selected from among: an amide, an ester, an ether, one or both esters of a phosphodiester, a phosphate ester, a carbamate, or a disulfide. In certain embodiments, a cleavable bond is one or both of the esters of a phosphodiester. In certain embodiments, a cleavable moiety comprises a phosphate or phosphodiester. In certain embodiments, the cleavable moiety is a phosphate or phosphodiester linkage between an oligonucleotide and a conjugate moiety or conjugate group.

In certain embodiments, a cleavable moiety comprises or consists of one or more linker-nucleosides. In certain such embodiments, the one or more linker-nucleosides are linked to one another and/or to the remainder of the oligomeric compound through cleavable bonds. In certain embodiments, such cleavable bonds are unmodified phosphodiester bonds. In certain embodiments, a cleavable moiety is 2'-deoxynucleoside that is attached to either the 3' or 5'-terminal nucleoside of an oligonucleotide by a phosphodiester internucleoside linkage and covalently attached to the remainder of the conjugate linker or conjugate moiety by a phosphate or phosphorothioate linkage. In certain such embodiments, the cleavable moiety is 2'-deoxyadenosine.

3. Cell-Targeting Moieties

In certain embodiments, a conjugate group comprises a cell-targeting moiety. In certain embodiments, a conjugate group has the general formula:

In certain embodiments, terminal groups comprise one or more 2'-linked nucleosides. In certain such embodiments, the 2'-linked nucleoside is an abasic nucleoside.

III. Oligomeric Duplexes

In certain embodiments, oligomeric compounds described herein comprise an oligonucleotide, having a nucleobase sequence complementary to that of a target nucleic acid. In certain embodiments, an oligomeric compound is paired with a second oligomeric compound to form an oligomeric duplex. Such oligomeric duplexes comprise a first oligomeric compound having a portion complementary to a target nucleic acid and a second oligomeric compound having a portion complementary to the first oligomeric compound. In certain embodiments, the first oligomeric compound of an oligomeric duplex comprises or consists of (1) a modified or unmodified oligonucleotide and optionally a conjugate group and (2) a second modified or unmodified oligonucleotide and optionally a conjugate group. Either or both oligomeric compounds of an oligomeric duplex may comprise a conjugate group. The oligonucleotides of each oligomeric compound of an oligomeric duplex may include non-complementary overhanging nucleosides.

IV. Antisense Activity

In certain embodiments, oligomeric compounds and oligomeric duplexes are capable of hybridizing to a target nucleic acid, resulting in at least one antisense activity; such oligomeric compounds and oligomeric duplexes are antisense compounds. In certain embodiments, antisense compounds have antisense activity when they reduce the amount or activity of a target nucleic acid by 25% or more in the standard cell assay. In certain embodiments, antisense compounds selectively affect one or more target nucleic acid.

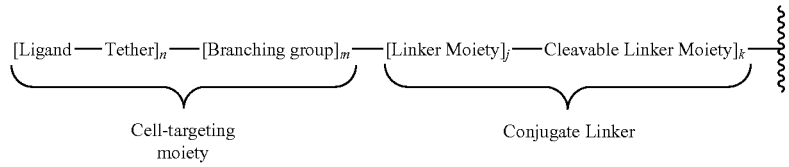

wherein n is from 1 to about 3, m is 0 when n is 1, m is 1 when n is 2 or greater, j is 1 or 0, and k is 1 or 0.

In certain embodiments, n is 1, j is 1 and k is 0. In certain embodiments, n is 1, j is 0 and k is 1. In certain embodiments, n is 1, j is 1 and k is 1. In certain embodiments, n is 2, j is 1 and k is 0. In certain embodiments, n is 2, j is 0 and k is 1. In certain embodiments, n is 2, j is 1 and k is 1. In certain embodiments, n is 3, j is 1 and k is 0. In certain embodiments, n is 3, j is 0 and k is 1. In certain embodiments, n is 3, j is 1 and k is 1.

In certain embodiments, conjugate groups comprise cell-targeting moieties that have at least one tethered ligand. In certain embodiments, cell-targeting moieties comprise two tethered ligands covalently attached to a branching group. In certain embodiments, cell-targeting moieties comprise three tethered ligands covalently attached to a branching group.

B. Certain Terminal Groups

In certain embodiments, oligomeric compounds comprise one or more terminal groups. In certain such embodiments, oligomeric compounds comprise a stabilized 5'-phosphate. Stabilized 5'-phosphates include, but are not limited to 5'-phosphonates, including, but not limited to 5'-vinylphosphonates. In certain embodiments, terminal groups comprise one or more abasic nucleosides and/or inverted nucleosides.

Such antisense compounds comprise a nucleobase sequence that hybridizes to one or more target nucleic acid, resulting in one or more desired antisense activity and does not hybridize to one or more non-target nucleic acid or does not hybridize to one or more non-target nucleic acid in such a way that results in significant undesired antisense activity.

In certain antisense activities, hybridization of an antisense compound to a target nucleic acid results in recruitment of a protein that cleaves the target nucleic acid. For example, certain antisense compounds result in RNase H mediated cleavage of the target nucleic acid. RNase H is a cellular endonuclease that cleaves the RNA strand of an RNA:DNA duplex. The DNA in such an RNA:DNA duplex need not be unmodified DNA. In certain embodiments, described herein are antisense compounds that are sufficiently "DNA-like" to elicit RNase H activity. In certain embodiments, one or more non-DNA-like nucleoside in the gap of a gapmer is tolerated.

In certain antisense activities, an antisense compound or a portion of an antisense compound is loaded into an RNA-induced silencing complex (RISC), ultimately resulting in cleavage of the target nucleic acid. For example, certain antisense compounds result in cleavage of the target nucleic acid by Argonaute. Antisense compounds that are loaded into RISC are RNAi compounds. RNAi compounds may be double-stranded (siRNA) or single-stranded (ssRNA).

In certain embodiments, hybridization of an antisense compound to a target nucleic acid does not result in recruitment of a protein that cleaves that target nucleic acid. In certain embodiments, hybridization of the antisense compound to the target nucleic acid results in alteration of splicing of the target nucleic acid. In certain embodiments, hybridization of an antisense compound to a target nucleic acid results in inhibition of a binding interaction between the target nucleic acid and a protein or other nucleic acid. In certain embodiments, hybridization of an antisense compound to a target nucleic acid results in alteration of translation of the target nucleic acid.

Antisense activities may be observed directly or indirectly. In certain embodiments, observation or detection of an antisense activity involves observation or detection of a change in an amount of a target nucleic acid or protein encoded by such target nucleic acid, a change in the ratio of splice variants of a nucleic acid or protein and/or a phenotypic change in a cell or subject.

V. Certain Target Nucleic Acids

In certain embodiments, oligomeric compounds comprise or consist of an oligonucleotide comprising a portion that is complementary to a target nucleic acid. In certain embodiments, the target nucleic acid is an endogenous RNA molecule. In certain embodiments, the target nucleic acid encodes a protein. In certain such embodiments, the target nucleic acid is selected from: a mature mRNA and a pre-mRNA, including intronic, exonic and untranslated regions. In certain embodiments, the target nucleic acid is a mature mRNA. In certain embodiments, the target nucleic acid is a pre-mRNA. In certain such embodiments, the target region is entirely within an intron. In certain embodiments, the target region spans an intron/exon junction. In certain embodiments, the target region is at least 50% within an intron.

A. Complementarity/Mismatches to the Target Nucleic Acid

It is possible to introduce mismatch bases without eliminating activity. For example, Gautschi et al (J. Natl. Cancer Inst. 93:463-471, March 2001) demonstrated the ability of an oligonucleotide having 100% complementarity to the bcl-2 mRNA and having 3 mismatches to the bcl-xL mRNA to reduce the expression of both bcl-2 and bcl-xL in vitro and in vivo. Furthermore, this oligonucleotide demonstrated potent anti-tumor activity in vivo. Maher and Dolnick (Nuc. Acid. Res. 16:3341-3358, 1988) tested a series of tandem 14 nucleobase oligonucleotides, and 28 and 42 nucleobase oligonucleotides comprised of the sequence of two or three of the tandem oligonucleotides, respectively, for their ability to arrest translation of human DHFR in a rabbit reticulocyte assay. Each of the three 14 nucleobase oligonucleotides alone was able to inhibit translation, albeit at a more modest level than the 28 or 42 nucleobase oligonucleotides.

In certain embodiments, oligonucleotides are complementary to the target nucleic acid over the entire length of the oligonucleotide. In certain embodiments, oligonucleotides are 99%, 95%, 90%, 85%, or 80% complementary to the target nucleic acid. In certain embodiments, oligonucleotides are at least 80% complementary to the target nucleic acid over the entire length of the oligonucleotide and comprise a portion that is 100% or fully complementary to a target nucleic acid. In certain embodiments, the portion of full complementarity is 6, 7, 8, 9, 10, 11, 12, 13, 14, 15, 16, 17, 18, 19, 20, 21, 22, 23, or 24 nucleobases in length.

In certain embodiments, oligonucleotides comprise one or more mismatched nucleobases relative to the target nucleic acid. In certain embodiments, antisense activity against the target is reduced by such mismatch, but activity against a non-target is reduced by a greater amount. Thus, in certain embodiments selectivity of the oligonucleotide is improved. In certain embodiments, the mismatch is specifically positioned within an oligonucleotide having a gapmer motif. In certain embodiments, the mismatch is at position 1, 2, 3, 4, 5, 6, 7, 8, 9, 10, or 11 from the 5'-end of the gap region. In certain embodiments, the mismatch is at position 1, 2, 3, 4, 5, or 6 from the 5'-end of the 5' wing region or the 3' wing region.

B. ATXN1

In certain embodiments, oligomeric compounds comprise or consist of an oligonucleotide that is complementary to a target nucleic acid, wherein the target nucleic acid is an ATXN1 nucleic acid. In certain embodiments, ATXN1 nucleic acid has the sequence set forth in SEQ ID NO: 1 (GENBANK Accession No. NM_000332.3), SEQ ID NO: 2 (the complement of GENBANK Accession No. NC_000006.12 truncated from nucleotides 16296001 to 16764000), SEQ ID NO: 3 (GENBANK Accession No. NM_001128164.1), SEQ ID NO: 4 (GENBANK Accession No. BC011026.1), SEQ ID NO: 5 (GENBANK Accession No. BC029401.1), or SEQ ID NO: 6 (GENBANK Accession No. BC047894.1).

In certain embodiments, contacting a cell with an oligomeric compound complementary to any of SEQ ID NO: 1-6 reduces the amount of ATXN1 RNA in a cell. In certain embodiments, contacting a cell with an oligomeric compound complementary to any of SEQ ID NO: 1-6 reduces the amount of ATXN1 in a cell. In certain embodiments, the cell is in vitro. In certain embodiments, the cell is in a subject. In certain embodiments, the oligomeric compound consists of a modified oligonucleotide. In certain embodiments, contacting a cell in a subject with an oligomeric compound complementary to any of SEQ ID NO: 1-6 ameliorates one or more symptom or hallmark of a neurodegenerative disease. In certain embodiments, the neurodegenerative disease is SCA1. In certain embodiments, the symptom or hallmark is selected from gait and limb ataxia, cognitive impairments, difficulty with speaking and swallowing, atrophy of the cerebellum and brainstem in magnetic resonance imaging (MRI), neurochemical abnormalities in the cerebellum and brainstem detected via magnetic resonance spectroscopy (MRS), and death within 10-15 years of symptom onset.

In certain embodiments, an oligomeric compound complementary to any of SEQ ID NO: 1-6 is capable of reducing the detectable amount of ATXN1 RNA in vitro by at least 10%, at least 20%, at least 30%, at least 40%, at least 50%, at least 60%, at least 70%, at least 80%, or at least 90% when administered according to the standard cell assay. In certain embodiments, an oligomeric compound complementary to SEQ ID NO: 1, SEQ ID NO: 2, SEQ ID NO: 3, SEQ ID NO: 4, SEQ ID NO: 5, or SEQ ID NO: 6 is capable of decreasing the amount of ATXN1 in vitro by at least 10%, at least 20%, at least 30%, at least 40%, at least 50%, at least 60%, at least 70%, at least 80%, or at least 90% when administered according to the standard cell assay. In certain embodiments, an oligomeric compound complementary to SEQ ID NO: 1, SEQ ID NO: 2, SEQ ID NO: 3, SEQ ID NO: 4, SEQ ID NO: 5, or SEQ ID NO: 6 is capable of reducing the detectable amount of ATXN1 RNA in the CSF of a subject by at least 10%, at least 20%, at least 30%, at least 40%, at least 50%, at least 60%, at least 70%, at least 80%, or at least 90%. In certain embodiments, an oligomeric compound complementary to SEQ ID NO: 1, SEQ ID NO: 2, SEQ ID NO: 3, SEQ ID NO: 4, SEQ ID NO: 5, or SEQ ID NO: 6 is capable of decreasing the detectable amount of ATXN1 in the CSF of a subject by at least 10%, at least 20%, at least 30%, at least 40%, at least 50%, at least 60%, at least 70%, at least 80%, or at least 90%.

C. Certain Target Nucleic Acids in Certain Tissues

In certain embodiments, oligomeric compounds comprise or consist of an oligonucleotide comprising a portion that is complementary to a target nucleic acid, wherein the target nucleic acid is expressed in a pharmacologically relevant tissue. In certain embodiments, the pharmacologically relevant tissues are the cells and tissues that comprise the central nervous system. Such tissues include the cortex, cerebellum, and brainstem.

VI. Certain Pharmaceutical Compositions

In certain embodiments, described herein are pharmaceutical compositions comprising one or more oligomeric compounds. In certain embodiments, the one or more oligomeric compounds each consists of a modified oligonucleotide. In certain embodiments, the pharmaceutical composition comprises a pharmaceutically acceptable diluent or carrier. In certain embodiments, a pharmaceutical composition comprises or consists of a sterile saline solution and one or more oligomeric compound. In certain embodiments, the sterile saline is pharmaceutical grade saline. In certain embodiments, a pharmaceutical composition comprises or consists of one or more oligomeric compound and sterile water. In certain embodiments, the sterile water is pharmaceutical grade water. In certain embodiments, a pharmaceutical composition comprises or consists of one or more oligomeric compound and phosphate-buffered saline (PBS). In certain embodiments, the sterile PBS is pharmaceutical grade PBS. In certain embodiments, a pharmaceutical composition comprises or consists of one or more oligomeric compound and artificial cerebrospinal fluid. In certain embodiments, the artificial cerebrospinal fluid is pharmaceutical grade.

In certain embodiments, a pharmaceutical composition comprises a modified oligonucleotide and artificial cerebrospinal fluid. In certain embodiments, a pharmaceutical composition consists of a modified oligonucleotide and artificial cerebrospinal fluid. In certain embodiments, a pharmaceutical composition consists essentially of a modified oligonucleotide and artificial cerebrospinal fluid. In certain embodiments, the artificial cerebrospinal fluid is pharmaceutical grade.

In certain embodiments, pharmaceutical compositions comprise one or more oligomeric compound and one or more excipients. In certain embodiments, excipients are selected from water, salt solutions, alcohol, polyethylene glycols, gelatin, lactose, amylase, magnesium stearate, talc, silicic acid, viscous paraffin, hydroxymethylcellulose and polyvinylpyrrolidone.

In certain embodiments, oligomeric compounds may be admixed with pharmaceutically acceptable active and/or inert substances for the preparation of pharmaceutical compositions or formulations. Compositions and methods for the formulation of pharmaceutical compositions depend on a number of criteria, including, but not limited to, route of administration, extent of disease, or dose to be administered.

In certain embodiments, pharmaceutical compositions comprising an oligomeric compound encompass any pharmaceutically acceptable salts of the oligomeric compound, esters of the oligomeric compound, or salts of such esters. In certain embodiments, pharmaceutical compositions comprising oligomeric compounds comprising one or more oligonucleotide, upon administration to a subject, including a human, are capable of providing (directly or indirectly) the biologically active metabolite or residue thereof. Accordingly, for example, the disclosure is also drawn to pharmaceutically acceptable salts of oligomeric compounds, prodrugs, pharmaceutically acceptable salts of such prodrugs, and other bioequivalents. Suitable pharmaceutically acceptable salts include, but are not limited to, sodium and potassium salts. In certain embodiments, prodrugs comprise one or more conjugate group attached to an oligonucleotide, wherein the conjugate group is cleaved by endogenous nucleases within the body.

Lipid moieties have been used in nucleic acid therapies in a variety of methods. In certain such methods, the nucleic acid, such as an oligomeric compound, is introduced into preformed liposomes or lipoplexes made of mixtures of cationic lipids and neutral lipids. In certain methods, DNA complexes with mono- or poly-cationic lipids are formed without the presence of a neutral lipid. In certain embodiments, a lipid moiety is selected to increase distribution of a pharmaceutical agent to a particular cell or tissue. In certain embodiments, a lipid moiety is selected to increase distribution of a pharmaceutical agent to fat tissue. In certain embodiments, a lipid moiety is selected to increase distribution of a pharmaceutical agent to muscle tissue.

In certain embodiments, pharmaceutical compositions comprise a delivery system. Examples of delivery systems include, but are not limited to, liposomes and emulsions. Certain delivery systems are useful for preparing certain pharmaceutical compositions including those comprising hydrophobic compounds. In certain embodiments, certain organic solvents such as dimethylsulfoxide are used.

In certain embodiments, pharmaceutical compositions comprise one or more tissue-specific delivery molecules designed to deliver the one or more pharmaceutical agents comprising an oligomeric compound provided herein to specific tissues or cell types. For example, in certain embodiments, pharmaceutical compositions include liposomes coated with a tissue-specific antibody.

In certain embodiments, pharmaceutical compositions comprise a co-solvent system. Certain of such co-solvent systems comprise, for example, benzyl alcohol, a nonpolar surfactant, a water-miscible organic polymer, and an aqueous phase. In certain embodiments, such co-solvent systems are used for hydrophobic compounds. A non-limiting example of such a co-solvent system is the VPD co-solvent system, which is a solution of absolute ethanol comprising 3% w/v benzyl alcohol, 8% w/v of the nonpolar surfactant Polysorbate 80™ and 65% w/v polyethylene glycol 300. The proportions of such co-solvent systems may be varied considerably without significantly altering their solubility and toxicity characteristics. Furthermore, the identity of co-solvent components may be varied: for example, other surfactants may be used instead of Polysorbate 80™; the fraction size of polyethylene glycol may be varied; other biocompatible polymers may replace polyethylene glycol, e.g., polyvinyl pyrrolidone; and other sugars or polysaccharides may substitute for dextrose.

In certain embodiments, pharmaceutical compositions are prepared for oral administration. In certain embodiments, pharmaceutical compositions are prepared for buccal administration. In certain embodiments, a pharmaceutical composition is prepared for administration by injection (e.g., intravenous, subcutaneous, intramuscular, intrathecal (IT), intracerebroventricular (ICV), etc.). In certain of such embodiments, a pharmaceutical composition comprises a carrier and is formulated in aqueous solution, such as water or physiologically compatible buffers such as Hanks's solution, Ringer's solution, or physiological saline buffer. In certain embodiments, other ingredients are included (e.g., ingredients that aid in solubility or serve as preservatives). In certain embodiments, injectable suspensions are prepared using appropriate liquid carriers, suspending agents and the like. Certain pharmaceutical compositions for injection are presented in unit dosage form, e.g., in ampoules or in multi-dose containers. Certain pharmaceutical compositions for injection are suspensions, solutions or emulsions in oily or aqueous vehicles, and may contain formulatory agents such as suspending, stabilizing and/or dispersing agents. Certain solvents suitable for use in pharmaceutical compositions for injection include, but are not limited to, lipophilic solvents and fatty oils, such as sesame oil, synthetic fatty acid esters, such as ethyl oleate or triglycerides, and liposomes.

VII. Certain Compositions

1. Compound No. 994509

In certain embodiments, Compound No. 994509 is characterized as a 5-10-5 MOE gapmer having a sequence of (from 5' to 3') GCACGGTATTAGTGTCTTCA (SEQ ID NO: 126), wherein each of nucleosides 1-5 and 16-20 (from 5' to 3') are 2'-MOE nucleosides and each of nucleosides 6-15 are 2'-β-D-deoxynucleosides, wherein the internucleoside linkages between nucleosides 2 to 3, 3 to 4, 4 to 5, 16 to 17, and 17 to 18 are phosphodiester internucleoside linkages and the internucleoside linkages between nucleosides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

In certain embodiments, Compound No. 994509 is represented by the following chemical notation (5' to 3'): Ges $^m$Ceo Aeo $^m$Ceo Ges Gds Tds Ads Tds Tds Ads Gds Tds Gds Tds $^m$Ceo Teo Tes $^m$Ces Ae (SEQ ID NO: 126), wherein, A=an adenine nucleobase,
$^m$C=a 5-methyl cytosine nucleobase,
G=a guanine nucleobase,
T=a thymine nucleobase,
e=a 2'-MOE sugar moiety,
d=a 2'-β-D deoxyribosyl sugar moiety,
s=a phosphorothioate internucleoside linkage, and
o=a phosphodiester internucleoside linkage.

In certain embodiments, Compound No. 994509 is represented by the following chemical structure:

(SEQ ID NO: 126)

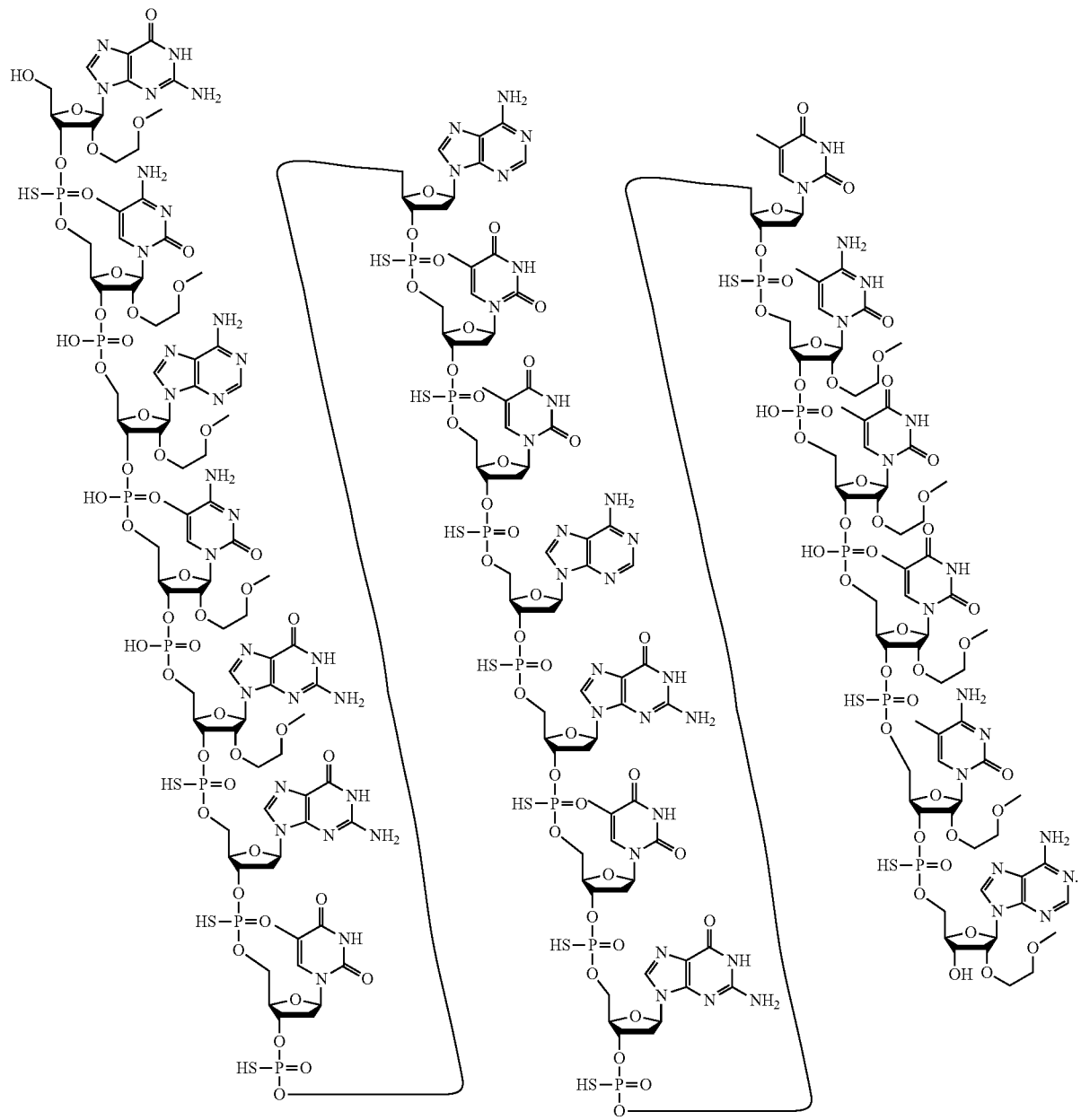

Structure 1. Compound No. 994509
In certain embodiments, the sodium salt of Compound No. 994509 is represented by the following chemical structure:

sides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

(SEQ ID NO: 126)

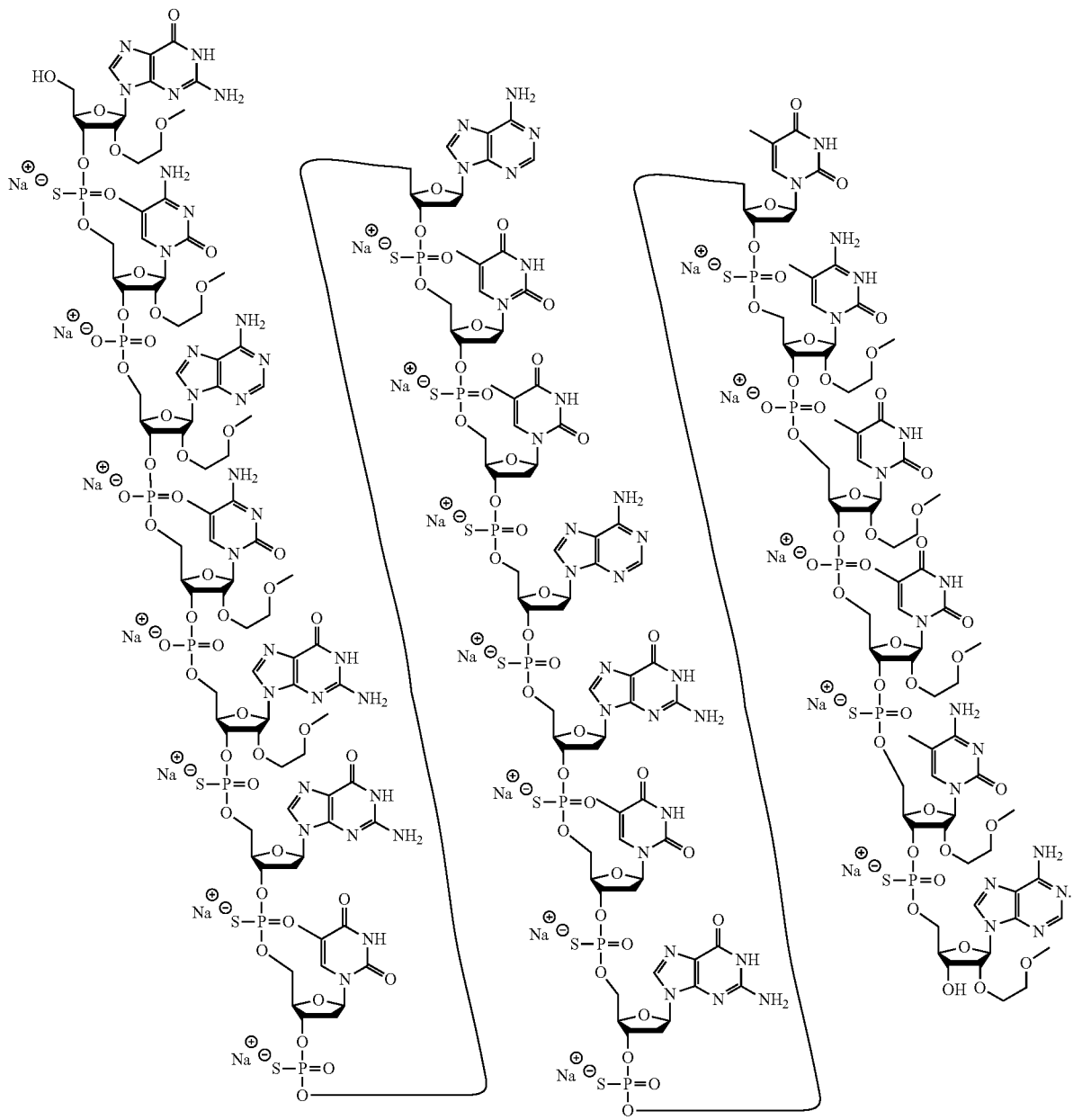

Structure 2. The sodium salt of Compound No. 994509

2. Compound No. 1040500

In certain embodiments, Compound No. 1040500 is characterized as a 5-10-5 MOE gapmer having a sequence of (from 5' to 3') GCTTCTCAAATCAGGTGTAC (SEQ ID NO: 1045), wherein each of (nucleosides 1-5 and 16-20 (from 5' to 3') are 2'-MOE nucleosides and each of nucleosides 6-15 are 2'-β-D-deoxynucleosides, wherein the internucleoside linkages between nucleosides 2 to 3, 3 to 4, 4 to 5, 16 to 17, and 17 to 18 are phosphodiester internucleoside linkages and the internucleoside linkages between nucleo- In certain embodiments, Compound No. 1040500 is represented by the following chemical notation (5' to 3'): Ges $^m$Ceo Teo Teo $^m$Ces Tds $^m$Cds Ads Ads Ads Tds $^m$Cds Ads Gds Gds Teo Geo Tes Aes $^m$Ce (SEQ ID NO: 1045), wherein, A=an adenine nucleobase,
$^m$C=a 5-methyl cytosine nucleobase,
G=a guanine nucleobase,
T=a thymine nucleobase,
e=a 2'-MOE sugar moiety,
d=a 2'-β-D deoxyribosyl sugar moiety, s=a phosphorothioate internucleoside linkage, and
o=a phosphodiester internucleoside linkage.
In certain embodiments, Compound No. 1040500 is represented by the following chemical structure:
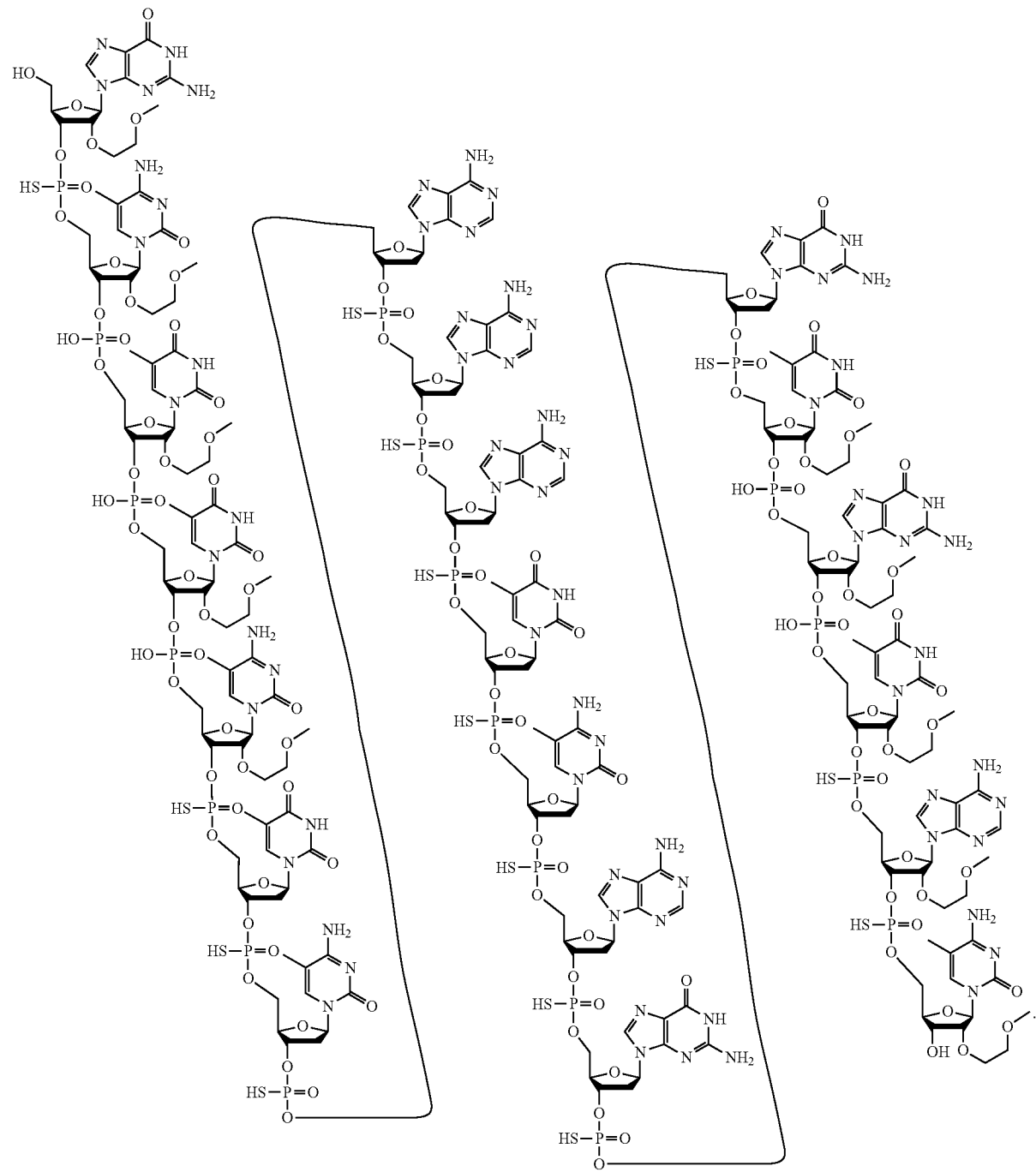
(SEQ ID NO: 1045)

Structure 3. Compound No. 1040500

In certain embodiments, the sodium salt of Compound No. 1040500 is represented by the following chemical structure:

are 2'-β-D-deoxynucleosides, wherein the internucleoside linkages between nucleosides 2 to 3, 3 to 4, 4 to 5, 16 to 17, and 17 to 18 are phosphodiester internucleoside linkages and the internucleoside linkages between nucleosides 1 to 2, 5 to (SEQ ID NO: 1045)

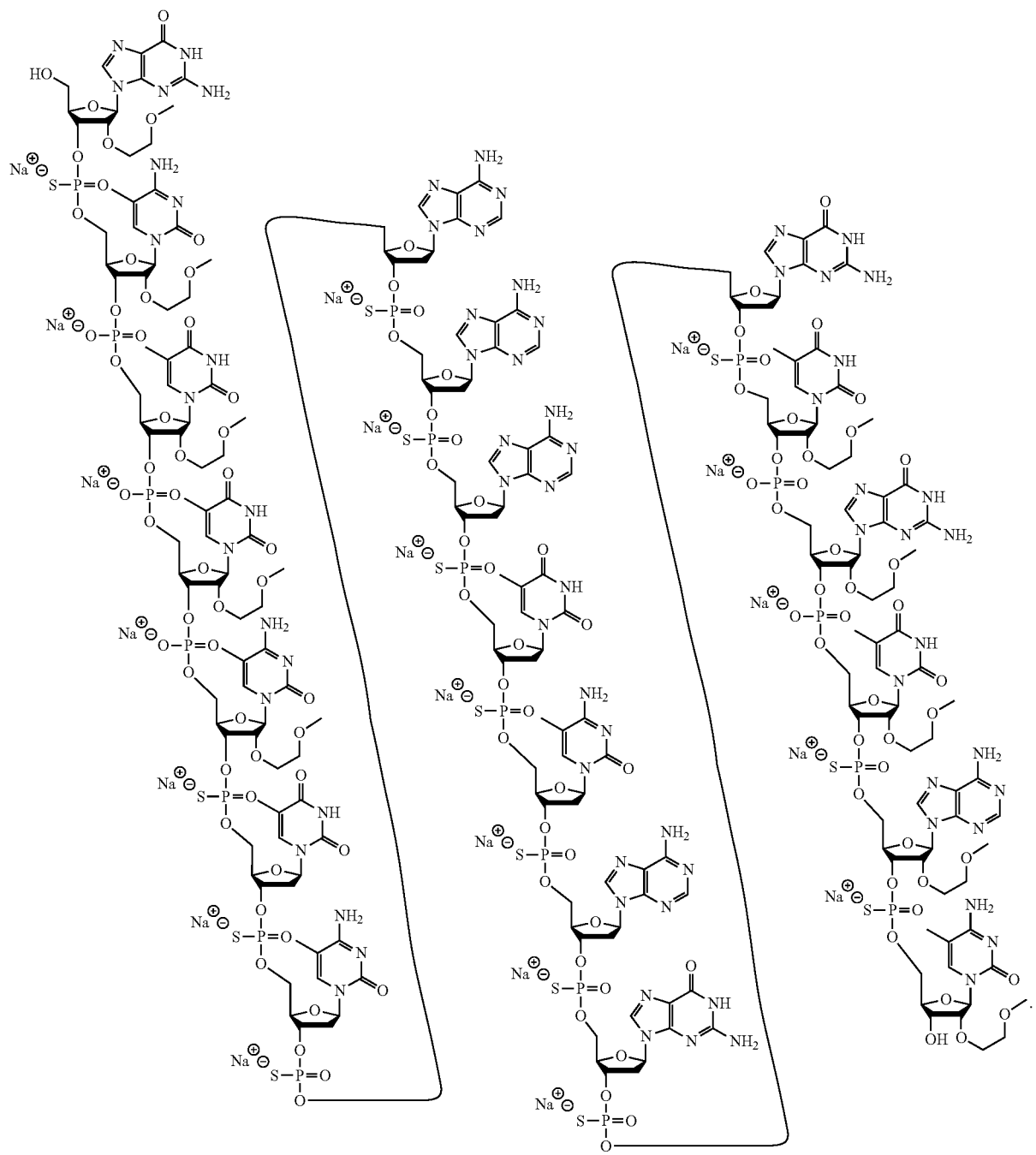

Structure 4. The sodium salt of Compound No. 1040500

3. Compound No. 1041927

In certain embodiments, Compound No. 1041927 is characterized as a 5-10-5 MOE gapmer having a sequence of (from 5' to 3') GCCTTTATAACTTTTCTTTC (SEQ ID NO: 2552), wherein each of nucleosides 1-5 and 16-20 (from 5' to 3') are 2'-MOE nucleosides and each of nucleosides 6-15

6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

In certain embodiments, Compound No. 1041927 is represented by the following chemical notation (5' to 3'): Ges mCeo mCeo Teo Tes Tds Ads Tds Ads Ads mCds Tds Tds Tds mCeo Teo Tes Tes mCe (SEQ ID NO: 2552), wherein,
A=an adenine nucleobase,
mC=a 5-methyl cytosine nucleobase,
G=a guanine nucleobase,
T=a thymine nucleobase,
e=a 2'-MOE sugar moiety,
d=a 2'-β-D deoxyribosyl sugar moiety,
s=a phosphorothioate internucleoside linkage, and
o=a phosphodiester internucleoside linkage.

In certain embodiments, Compound No. 1041927 is represented by the following chemical structure:

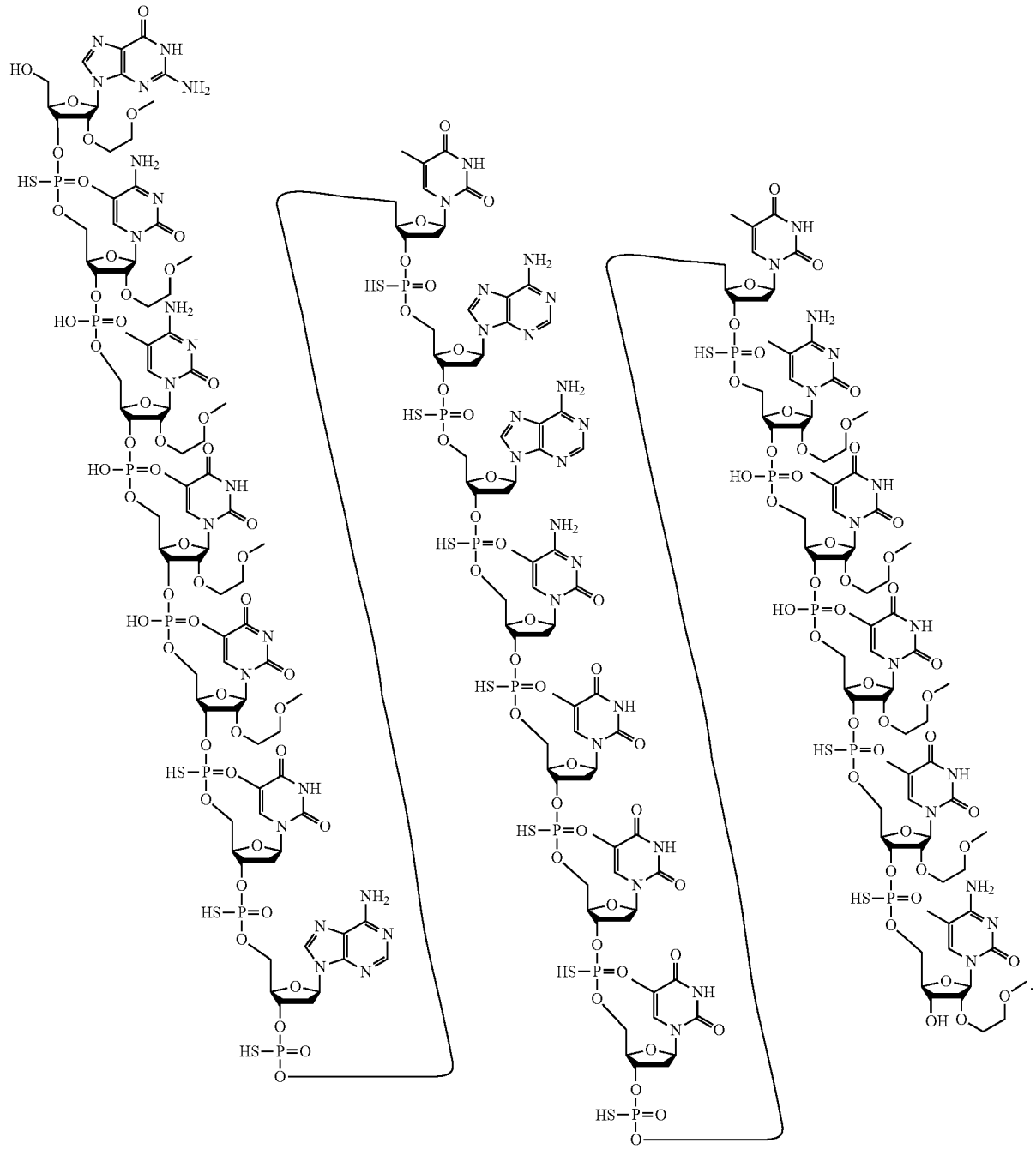

(SEQ ID NO: 2552)

Structure 5. Compound No. 1041927

In certain embodiments, the sodium salt of Compound No. 1041927 is represented by the following chemical structure:

sides 6-15 are 2'-β-D-deoxynucleosides, wherein the internucleoside linkages between nucleosides 2 to 3, 3 to 4, 4 to 5, 16 to 17, and 17 to 18 are phosphodiester internucleoside linkages and the internucleoside linkages between nucleosides 1 to 2, 5 to 6, 6 to 7, 7 to 8, 8 to 9, 9 to 10, 10 to 11, (SEQ ID NO: 2552)

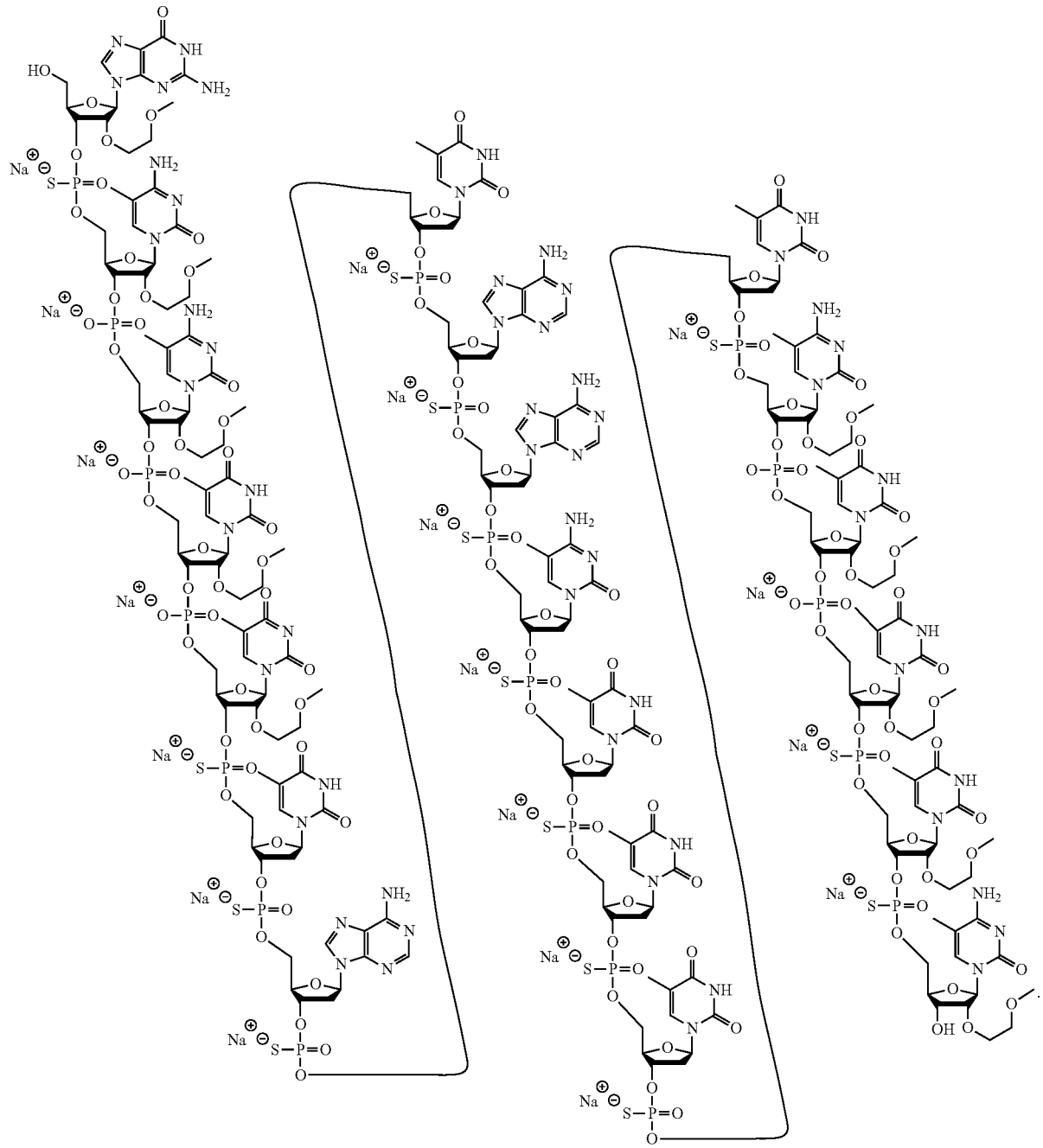

Structure 6. The Sodium Salt of Compound No. 1041927

4. Compound No. 1055001

In certain embodiments, Compound No. 1055001 is characterized as a 5-10-5 MOE gapmer having a sequence of (from 5' to 3') TTCAGTTTAGTTGCAGCCAT (SEQ ID NO: 3190), wherein each of nucleosides 1-5 and 16-20 (from 5' to 3') are 2'-MOE nucleosides and each of nucleo- 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

In certain embodiments, Compound No. 1055001 is represented by the following chemical notation (5' to 3'): Tes Teo $^m$Ceo Aeo Ges Tds Tds Tds Ads Gds Tds Tds Gds $^m$Cds Ads Geo $^m$Ceo $^m$Ces Aes Te (SEQ ID NO: 3190), wherein, A=an adenine nucleobase,
$^{m}$C=a 5-methyl cytosine nucleobase,
G=a guanine nucleobase,
T=a thymine nucleobase,
e=a 2'-MOE sugar moiety,
d=a 2'-β-D deoxyribosyl sugar moiety,
s=a phosphorothioate internucleoside linkage, and
o=a phosphodiester internucleoside linkage.

In certain embodiments, Compound No. 1055001 is represented by the following chemical structure:

(SEQ ID NO: 3190)

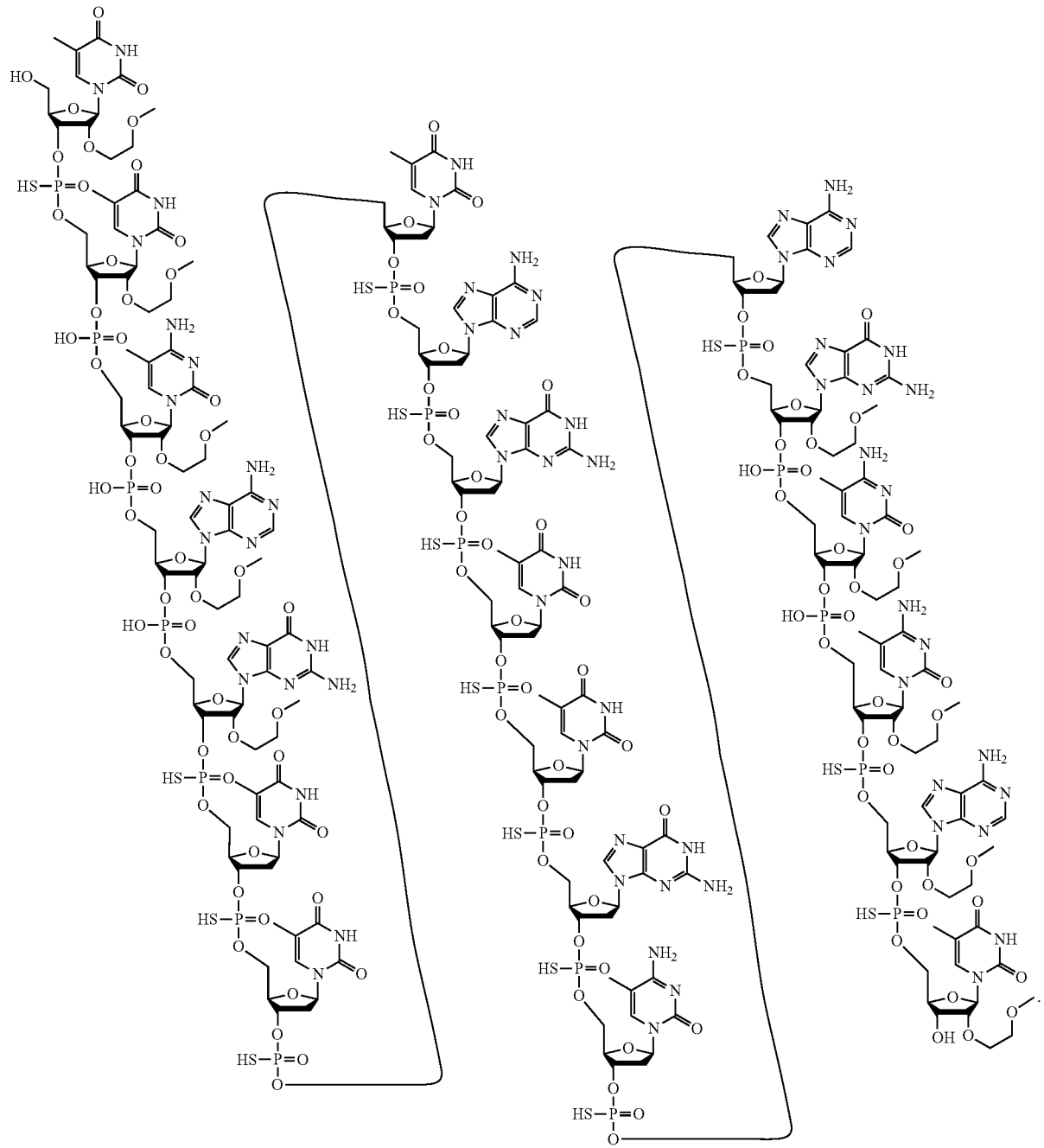

Structure 7. Compound No. 1055001

In certain embodiments, the sodium salt of Compound No. 1055001 is represented by the following chemical structure:

nucleoside linkages between nucleosides 2 to 3, 3 to 4, 4 to 5, 16 to 17, and 17 to 18 are phosphodiester internucleoside linkages and the internucleoside linkages between nucleosides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and (SEQ ID NO: 3190)

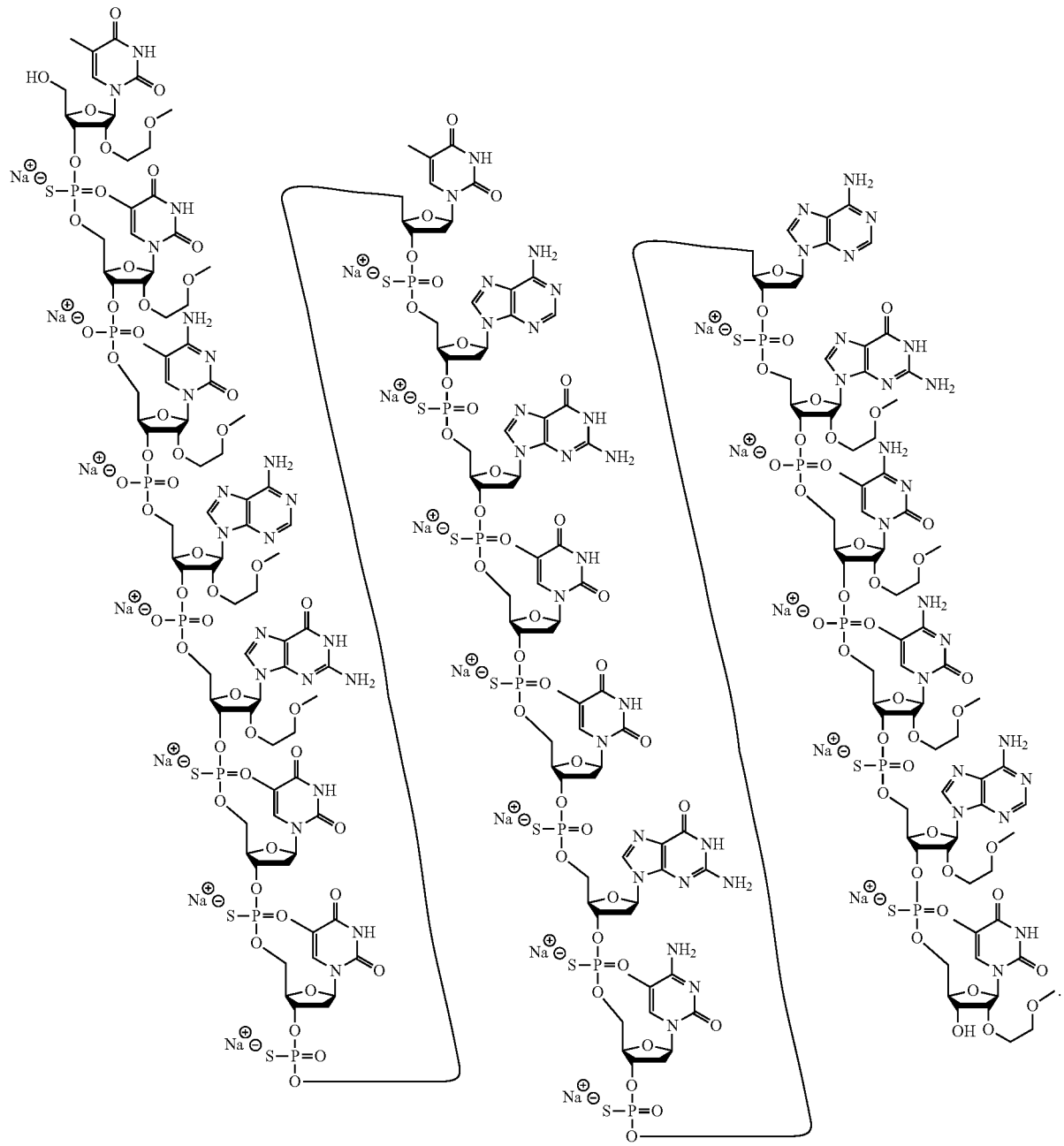

Structure 8. The Sodium Salt of Compound No. 1055001

5. Compound No. 1371311

In certain embodiments, Compound No. 1371311 is characterized as a 5-10-5 MOE gapmer having a sequence of (from 5' to 3') CCCGTA TTCCTCTTA CCATC (SEQ ID NO: 3590), wherein each of nucleosides 1-5 and 16-20 (from 5' to 3') are 2'-MOE nucleosides and each of nucleosides 6-15 are 2'-β-D-deoxynucleosides, wherein the inter- 19 to 20 are phosphorothioate internucleoside linkages, and wherein each cytosine is a 5-methyl cytosine.

In certain embodiments, Compound No. 1371311 is represented by the following chemical notation (5' to 3'): $^m$Ces $^m$Ceo $^m$Ceo Geo Tes Ads Tds Tds $^m$Cds $^m$Cds Tds $^m$Cds Tds Tds Ads $^m$Ceo $^m$Ceo Aes Tes $^m$Ce (SEQ ID NO: 3590), wherein,

111

A=an adenine nucleobase,
$^{m}$C=a 5-methyl cytosine nucleobase,
G=a guanine nucleobase,
T=a thymine nucleobase,
e=a 2'-MOE sugar moiety,

112 d=a 2'-β-D deoxyribosyl sugar moiety,
s=a phosphorothioate internucleoside linkage, and
o=a phosphodiester internucleoside linkage.

In certain embodiments, Compound No. 1371311 is represented by the following chemical structure:

(SEQ ID NO: 3590)

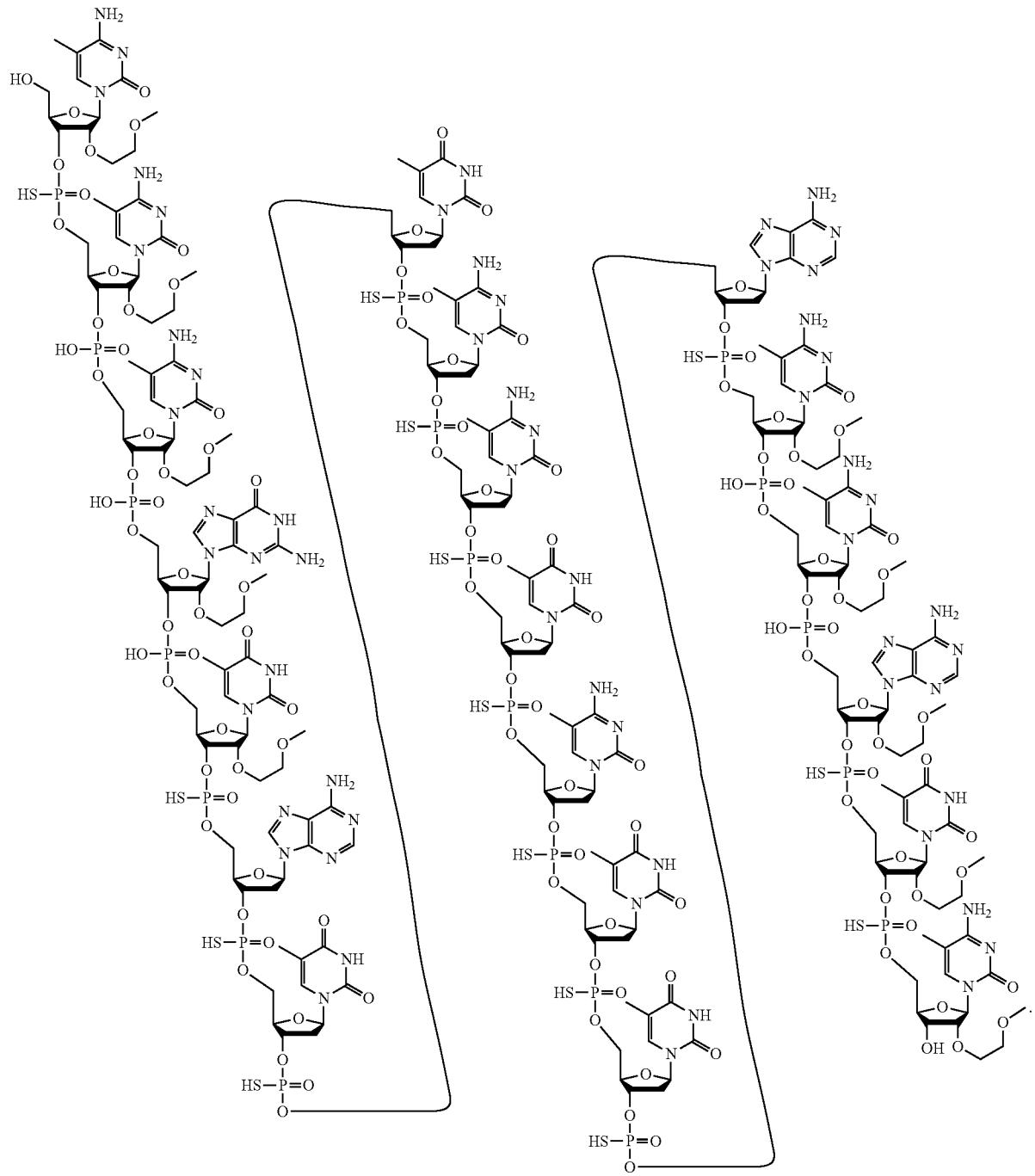

Structure 9. Compound No. 1371311

In certain embodiments, the sodium salt of Compound No. 1371311 is represented by the following chemical structure:

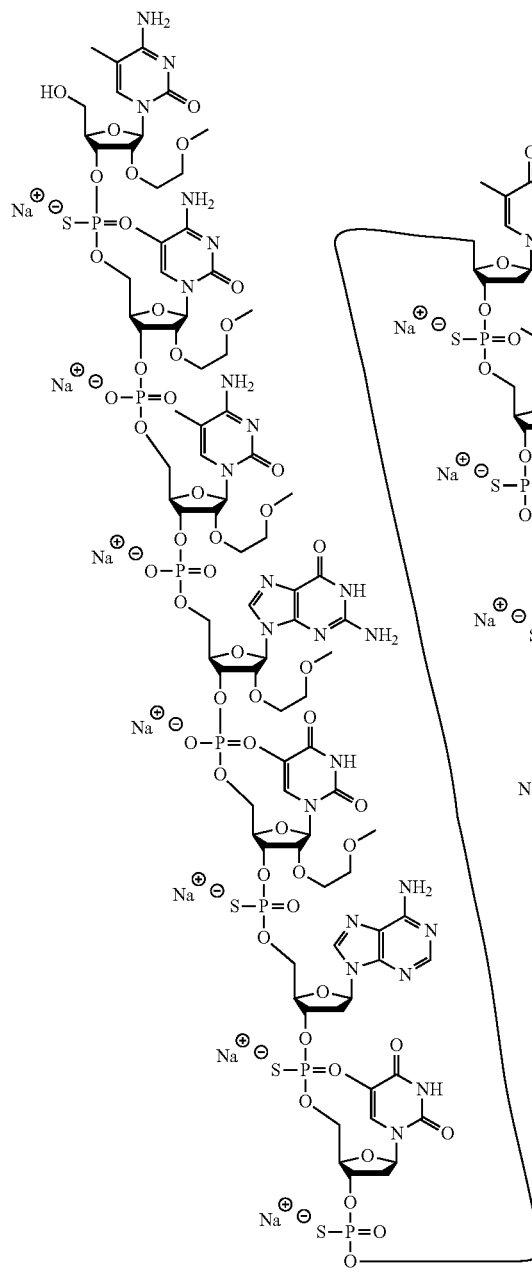
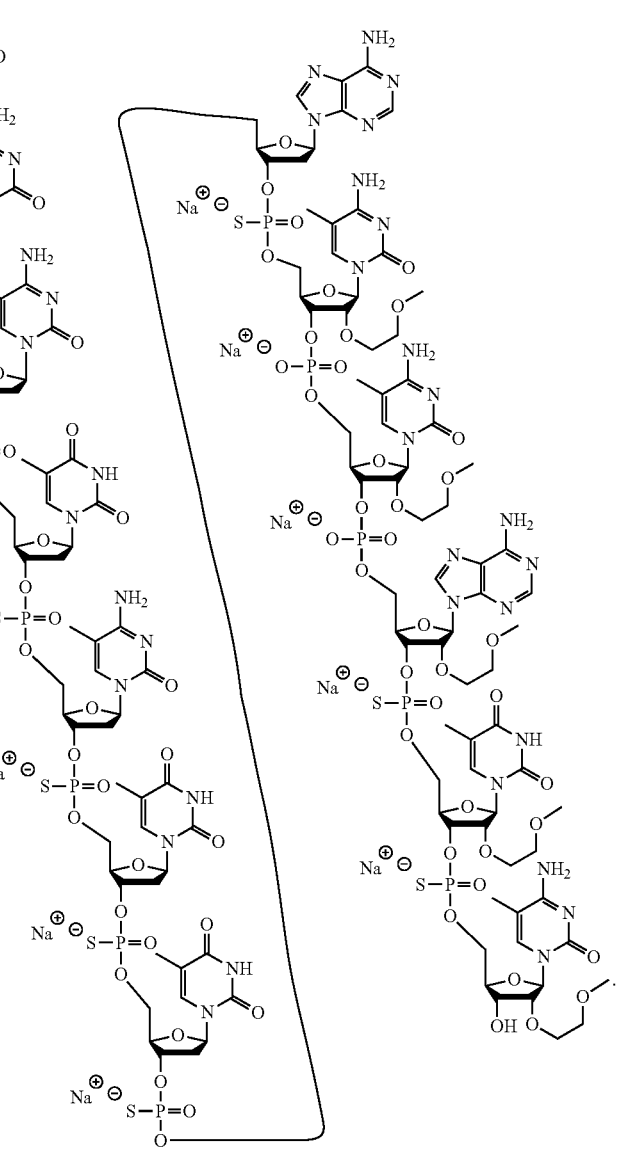

Structure 10. The Sodium Salt of Compound No. 1371311

6. Compound No. 1385293

In certain embodiments, Compound No. 1385293 is characterized as a 5-8-4 MOE gapmer having a sequence of (from 5' to 3') TCAGTTTAGTTGCAGCC (SEQ TD NO: 3638), wherein each of nucleosides 1-5 and 14-17 (from 5' to 3') are 2'-MOE nucleosides and each of nucleosides 6-13 are 2'-β-D-deoxynucleosides, wherein the internucleoside linkages between nucleosides 4 to 5 and 14 to 15 are phosphodiester internucleoside linkages and the internucleoside linkages between nucleosides to 2, 3 to 4, 5 to 6, 6 to 7, 7 to 8, 8 to 9, 9 to 10, 10 to 11, 11 to 12, 12 to 13, 13 to (SEQ ID NO: 3590)

14, 15 to 16, and 16 to 17 are phosphorothioate internucleoside linkages, and wherein each cytosine is a 5-methyl cytosine.

In certain embodiments, Compound No. 1385293 is represented by the following chemical notation (5' to 3'): Tes $^m$Ces Aes Geo Tes Tds Tds Ads Gds Tds Tds Gds $^m$Cds Aeo Ges $^m$Ces $^m$Ce (SEQ ID NO: 3638), wherein,

115

A=an adenine nucleobase,
$^m$C=a 5-methyl cytosine nucleobase,
G=a guanine nucleobase,
T=a thymine nucleobase,
e=a 2'-MOE sugar moiety,

116 d=a 2'-β-D deoxyribosyl sugar moiety,
s=a phosphorothioate internucleoside linkage, and
o=a phosphodiester internucleoside linkage.

In certain embodiments, Compound No. 1385293 is represented by the following chemical structure:

(SEQ ID NO: 3638)

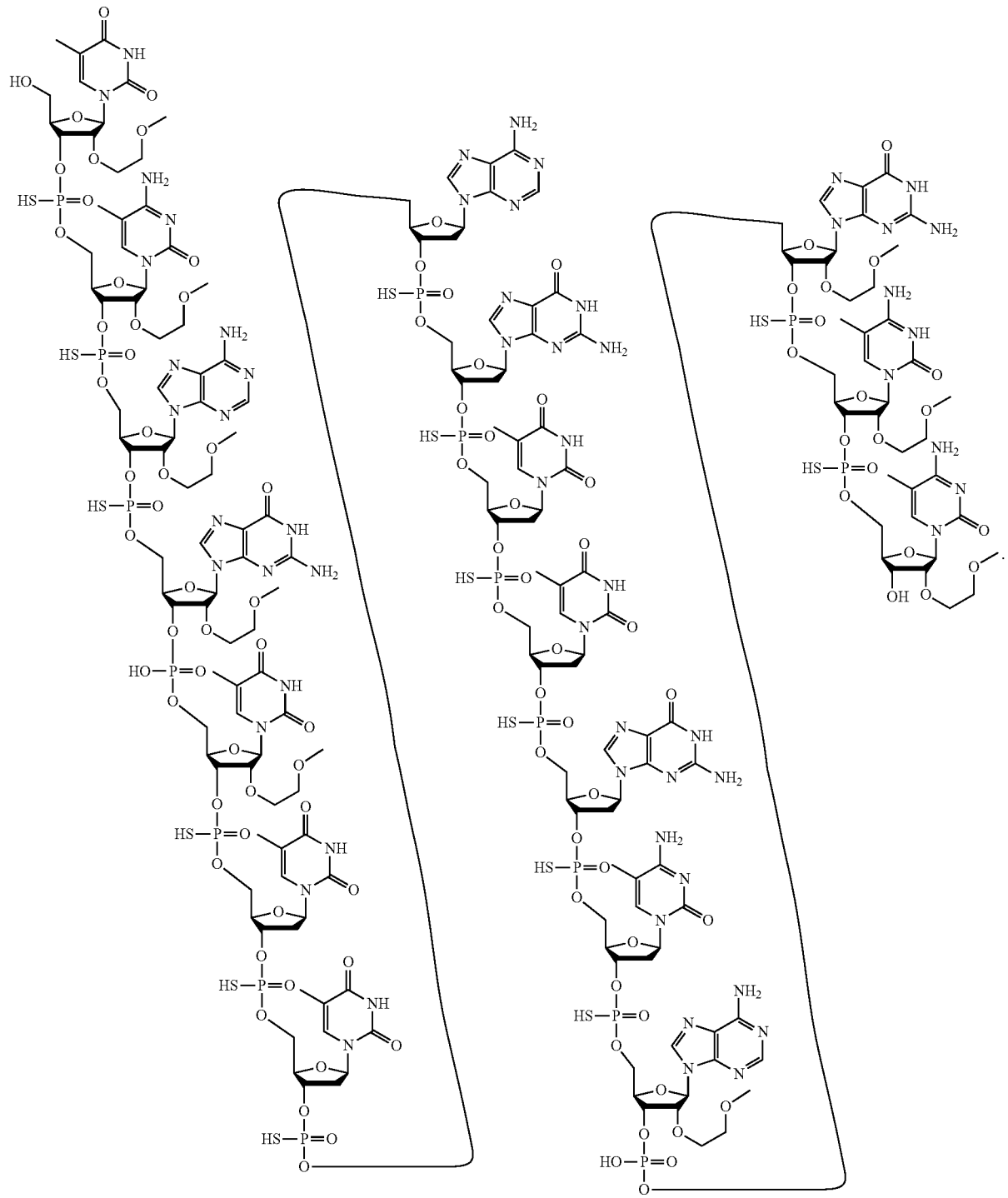

Structure 11. Compound No. 1385293

In certain embodiments, the sodium salt of Compound No. 1385293 is represented by the following chemical structure:

(SEQ ID NO: 3638)

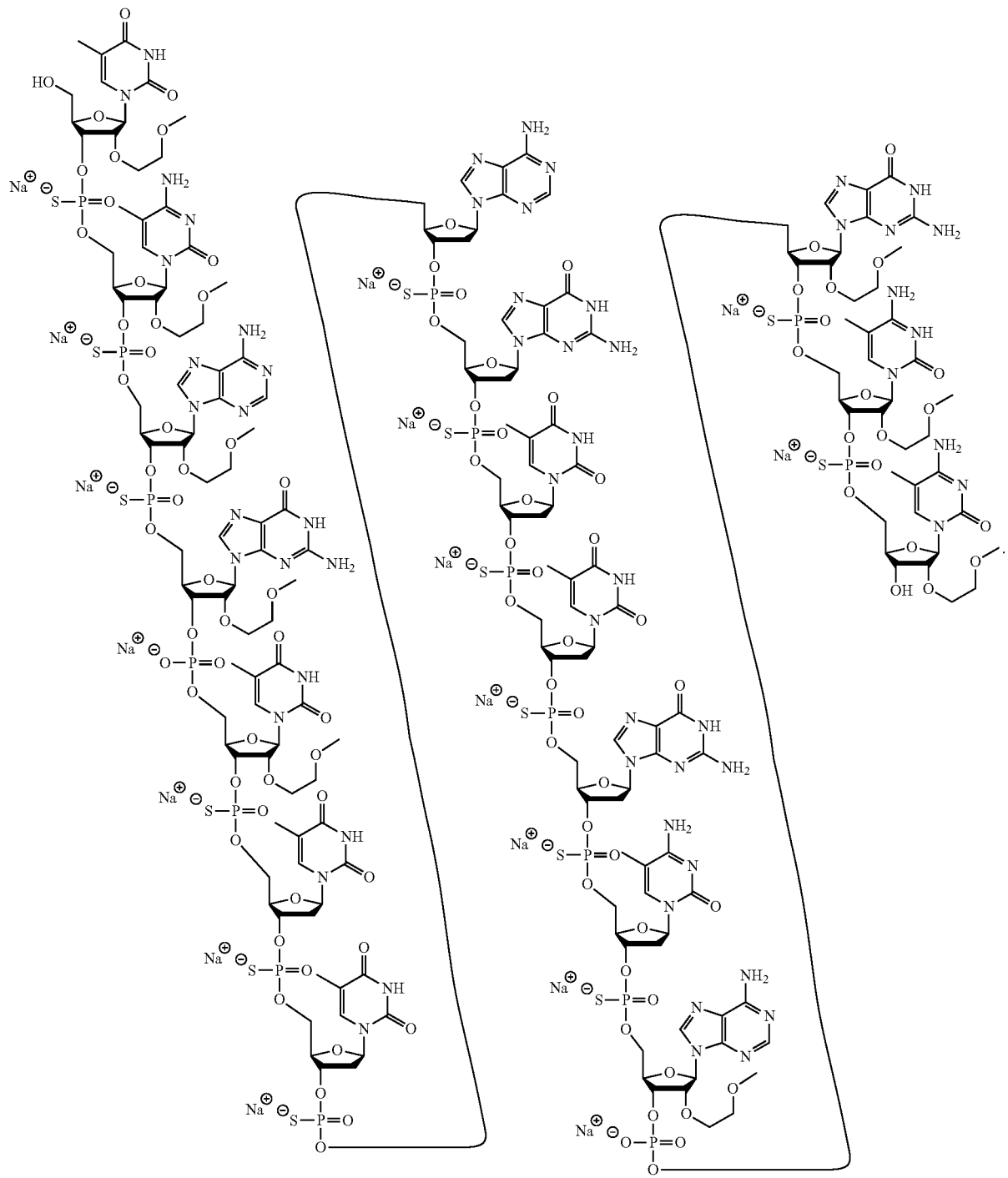

Structure 12. The Sodium Salt of Compound No. 1385293

VIII. Certain Hotspot Regions

In certain embodiments, nucleobases in the ranges specified below comprise a hotspot region of ATXN1 nucleic acid. In certain embodiments, modified oligonucleotides that are complementary within a hotspot region of ATXN1 nucleic acid achieve an average of more than 75% reduction of ATXN1 RNA in vitro in the standard cell assay. In certain embodiments, modified oligonucleotides that are complementary within a hotspot region of ATXN1 nucleic acid achieve an average of 24% or greater reduction of ATXN1 RNA in vivo in the standard in vivo assay. In certain embodiments, modified oligonucleotides that are complementary within a hotspot region of ATXN1 nucleic acid achieve an average of 45% or greater reduction of ATXN1 RNA in vivo in the standard in vivo assay.

1. Nucleobases 5472-5552 of SEQ ID NO: 1 or 459725-459805 of SEQ ID NO: 2

In certain embodiments, nucleobases 5472-5552 of SEQ TD NO: 1 or 459725-459805 of SEQ ID NO: 2 comprise a hotspot region. In certain embodiments, modified oligonucleotides are complementary within nucleobases 5472-5552 of SEQ TD NO: 1 or 459725-459805 of SEQ TD NO: 2. In certain embodiments, modified oligonucleotides are 20 nucleobases in length. In certain embodiments, modified oligonucleotides are 17 nucleobases in length. In certain embodiments, modified oligonucleotides are gapmers. In certain embodiments, modified oligonucleotides are mixed wing gapmers.

In certain embodiments, the gapmers are 5-10-5 MOE gapmers. In certain embodiments, the gapmers are 6-10-4 MOE gapmers. In certain embodiments, the gapmers are 5-8-4 MOE gapmers or 5-8-4 mixed MOE/cEt gapmers. In certain embodiments, the mixed wing gapmers have the sugar motif in order from 5' to 3': eeeeedddddddkkee; wherein 'd' represents a 2'-β-D-deoxyribosyl sugar moiety, 'k' represents a cEt sugar moiety, and 'e' represents a 2'-MOE sugar moiety. In certain embodiments, the gapmers comprise a 2'-substituted nucleoside in the gap. In certain embodiments, the 2'-substituted nucleoside comprises a 2'-OMe sugar moiety. In certain embodiments, the 2'-substituted nucleoside is at position 2 of the gap (5' to 3'). In certain embodiments, the gapmers have the sugar motif in order from 5' to 3': eeeeedydddddddeeeee or eeeeedyddddddkkee; wherein 'd' represents a 2'-β-D-deoxyribosyl sugar moiety, 'k' represents a cEt sugar moiety, 'e' represents a 2'-MOE sugar moiety, and "y" represents a 2'-OMe sugar moiety. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in order from 5' to 3': In certain embodiments, modified nucleotides have an internucleoside linkage motif of sooosssssssssssooss, sssosssssssssssosss, sssosssssssssssoss, or sooooosssssssssssoss wherein each "s" represents a phosphorothioate internucleoside linkage and each "o" represents a phosphodiester internucleoside linkage.

The nucleobase sequences of SEQ ID Nos: 196, 274, 352, 430, 508, 2578, 2655, 2732, 2809, 2886, 2963, 3121, 3122, 3190, 3191, 3192, 3262, 3330, 3331, 3332, 3401, 3402, 3575, 3577, 3620, 3624, 3638-3640, 3653-3655, 3662, 3665, and 3669 are complementary within nucleobases 5472-5552 of SEQ ID NO: 1 or 459725-459805 of SEQ ID NO: 2.

The nucleobase sequence of Compound Nos.: 994446-994450, 1040296-1040301, 1055001-1055011, 1342062, 1342063, 1342067, 1342068, 1365271, 1365272, 1365274, 1365294, 1365299, 1365300, 1371818, 1371821, 1371827, 1371829, 1371837, 1371843, 1371866, 1371869, 1371871, 1371876, 1385293, 1394156-1394160, 1394162, 1394164, 1394166-1394168, 1394533, 1394544, 1394546, 1394549, and 1394553 are complementary within nucleobases 5472-5552 of SEQ ID NO: 1 or 459725-459805 of SEQ ID NO: 2.

In certain embodiments, modified oligonucleotides complementary within nucleobases 5472-5552 of SEQ ID NO: 1 or 459725-459805 of SEQ ID NO: 2 achieve at least 58% reduction of ATXN1 RNA in vitro in the standard cell assay. In certain embodiments, modified oligonucleotides complementary within nucleobases 5472-5552 of SEQ ID NO: 1 or 459725-459805 of SEQ ID NO: 2 achieve an average of 90% reduction of ATXN1 RNA in vitro in the standard cell assay. In certain embodiments, modified oligonucleotides complementary within nucleobases 5472-5552 of SEQ ID NO: 1 or 459725-459805 of SEQ ID NO: 2 achieve an average of 52% reduction of ATXN1 RNA in vivo in the standard in vivo assay.

2. Nucleobases 5906-6005 of SEQ ID NO: 1 or 460159-460258 of SEQ ID NO: 2

In certain embodiments, nucleobases 5906-6005 of SEQ ID NO: 1 or 460159-460258 of SEQ ID NO: 2 comprise a hotspot region. In certain embodiments, modified oligonucleotides are complementary to nucleobases 5906-6005 of SEQ ID NO: 1 or 460159-460258 of SEQ ID NO: 2. In certain embodiments, modified oligonucleotides are 20 nucleobases in length. In certain embodiments, modified oligonucleotides are 17 nucleobases in length. In certain embodiments, modified oligonucleotides are mixed wing gapmers.

In certain embodiments, the gapmers are 5-10-5 MOE gapmers. In certain embodiments, the gapmers are 6-10-4 MOE gapmers. In certain embodiments, the gapmers are 5-8-4 MOE gapmers or 5-8-4 mixed MOE/cEt gapmers. In certain embodiments, the mixed wing gapmers have the sugar motif in order from 5' to 3': eeeeedddddddkkee; wherein 'd' represents a 2'-β-D-deoxyribosyl sugar moiety, 'k' represents a cEt sugar moiety, and 'e' represents a 2'-MOE sugar moiety.

In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in order from 5' to 3': In certain embodiments, modified nucleotides have an internucleoside linkage motif of sooosssssssssssooss, sssosssssssssssosss, sssosssssssssssoss, or sooooosssssssssssoss wherein each "s" represents a phosphorothioate internucleoside linkage and each "o" represents a phosphodiester internucleoside linkage.

The nucleobase sequences of SEQ ID Nos: 42, 120, 198, 276, 509, 587, 2502, 2579, 2656, 2733, 2810, 2887, 2964, 3585, 3588-3590, 3615, 3618, 3622, 3657, 3660, 3661, 3663, 3664, and 3666-3668 are complementary within nucleobases 5906-6005 of SEQ ID NO: 1 or 460159-460258 of SEQ ID NO: 2.

The nucleobase sequence of Compound Nos.: 994458-994463, 1040327-1040333, 1367569, 1367580-1367581, 1367589-1367591, 1371311, 1371820, 1371823, 1371825, 1371842, 1371865, 1371868, 1371870, 1371873, 1371875, 1371877, 1394161, 1394163, 1394165, 1394524, 1394538, 1394541, 1394543, 1394545, 1394548, and 1394550-1394552 are complementary within nucleobases 5906-6005 of SEQ ID NO: 1 or 460159-460258 of SEQ ID NO: 2.

In certain embodiments, modified oligonucleotides complementary within 5906-6005 of SEQ ID NO: 1 or 460159-460258 of SEQ ID NO: 2 achieve at least 26% reduction of ATXN1 RNA in vitro in the standard cell assay. In certain embodiments, modified oligonucleotides complementary within nucleobases 5906-6005 of SEQ ID NO: 1 or 460159-460258 of SEQ ID NO: 2 achieve an average of 78% reduction of ATXN1 RNA in vitro in the standard cell assay. In certain embodiments, modified oligonucleotides complementary within nucleobases 5906-6005 of SEQ ID NO: 1 or 460159-460258 of SEQ ID NO: 2 achieve an average of 51% reduction of ATXN1 RNA in vivo in the standard in vivo assay.

3. Nucleobases 7868-7911 of SEQ ID NO: 1 or 462121-462164 of SEQ ID NO: 2

In certain embodiments, nucleobases 7868-7911 of SEQ ID NO: 1 or 462121-462164 of SEQ ID NO: 2 comprise a hotspot region. In certain embodiments, modified oligonucleotides are complementary to nucleobases 7868-7911 of SEQ ID NO: 1 or 462121-462164 of SEQ ID NO: 2. In certain embodiments, modified oligonucleotides are 20 nucleobases in length. In certain embodiments, modified oligonucleotides are gapmers.

In certain embodiments, the gapmers are 5-10-5 MOE gapmers. In certain embodiments, the gapmers are 6-10-4 MOE gapmers.

In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in order from 5' to 3': In certain embodiments, modified nucleotides have an internucleoside linkage motif of soooossssssssssssooss, sssosssssssssssosss, or sooooosssssssssssoss wherein each "s" represents a phosphorothioate internucleoside linkage and each "o" represents a phosphodiester internucleoside linkage.

The nucleobase sequences of SEQ ID Nos: 48, 126, 2044, and 2121 are complementary within nucleobases 7868-7911 of SEQ ID NO: 1 or 462121-462164 of SEQ ID NO: 2.

The nucleobase sequence of Compound Nos.: 994508, 994509, 1040499, 1040450, 1394513, and 1394529 are complementary within nucleobases 7868-7911 of SEQ ID NO: 1 or 462121-462164 of SEQ ID NO: 2.

In certain embodiments, modified oligonucleotides complementary within 7868-7911 of SEQ ID NO: 1 or 462121-462145 of SEQ ID NO: 2 achieve at least 61% reduction of ATXN1 RNA in vitro in the standard cell assay. In certain embodiments, modified oligonucleotides complementary within nucleobases 7868-7911 of SEQ ID NO: 1 or 462121-462145 of SEQ ID NO: 2 an average of 79% reduction of ATXN1 RNA in vitro in the standard cell assay. In certain embodiments, modified oligonucleotides complementary within nucleobases 7868-7911 of SEQ ID NO: 1 or 462121-462164 of SEQ ID NO: 2 achieve an average of 53% reduction of ATXN1 RNA in vivo in the standard in vivo assay.

4. Nucleobases 8481-8514 of SEQ ID NO: 1 or 462734-462767 of SEQ ID NO: 2

In certain embodiments, nucleobases 8481-8514 of SEQ ID NO: 1 or 462734-462767 of SEQ ID NO: 2 comprise a hotspot region. In certain embodiments, modified oligonucleotides are complementary to nucleobases 8481-8514 of SEQ ID NO: 1 or 462734-462767 of SEQ ID NO: 2. In certain embodiments, modified oligonucleotides are 20 nucleobases in length. In certain embodiments, modified oligonucleotides are gapmers.

In certain embodiments, the gapmers are 5-10-5 MOE gapmers. In certain embodiments, the gapmers are 6-10-4 MOE gapmers.

In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in order from 5' to 3': In certain embodiments, modified nucleotides have an internucleoside linkage motif of soooossssssssssssooss, sssosssssssssssosss, or sooooosssssssssssoss wherein each "s" represents a phosphorothioate internucleoside linkage and each "o" represents a phosphodiester internucleoside linkage.

The nucleobase sequences of SEQ ID Nos: 128, 206, 284, 1045, 1122, 1199, and 1276 are complementary within nucleobases 8481-8514 of SEQ ID NO: 1 or 462734-462767 of SEQ ID NO: 2.

The nucleobase sequence of Compound Nos.: 994525-994527, 1040500-1040503, 1394514, and 1394525 are complementary within nucleobases 8481-8514 of SEQ ID NO: 1 or 462734-462767 of SEQ ID NO: 2.

In certain embodiments, modified oligonucleotides complementary within 8481-8514 of SEQ ID NO: 1 or 462734-462767 of SEQ ID NO: 2 achieve at least 54% reduction of ATXN1 RNA in vitro in the standard cell assay. In certain embodiments, modified oligonucleotides complementary within nucleobases 8481-8514 of SEQ ID NO: 1 or 462734-462767 of SEQ ID NO: 2 achieve an average of 79% reduction of ATXN1 RNA in vitro in the standard cell assay. In certain embodiments, modified oligonucleotides complementary within nucleobases 8481-8514 of SEQ ID NO: 1 or 462734-462767 of SEQ ID NO: 2 achieve an average of 48% reduction of ATXN1 RNA in vivo in the standard in vivo assay.

5. Nucleobases 446679-446706 of SEQ ID NO: 2

In certain embodiments, nucleobases 446679-446706 of SEQ ID NO: 2 comprise a hotspot region. In certain embodiments, modified oligonucleotides are complementary to nucleobases 446679-446706 of SEQ ID NO: 2. In certain embodiments, modified oligonucleotides are 20 nucleobases in length. In certain embodiments, modified oligonucleotides are gapmers.

In certain embodiments, the gapmers are 5-10-5 MOE gapmers. In certain embodiments, the gapmers are 6-10-4 MOE gapmers.

In certain embodiments, 446679-446706 of SEQ ID NO: 2 comprise a hotspot region. In certain embodiments, modified oligonucleotides are complementary within 446679-446706 of SEQ ID NO: 2. In certain embodiments, modified oligonucleotides are 20 nucleobases in length. In certain embodiments, modified oligonucleotides are 17 nucleobases in length. In certain embodiments, modified oligonucleotides are gapmers. In certain embodiments, the gapmers are MOE gapmers. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in order from 5' to 3': In certain embodiments, modified nucleotides have an internucleoside linkage motif of soooossssssssssssooss, sssosssssssssssosss, or sooooosssssssssssoss wherein each "s" represents a phosphorothioate internucleoside linkage and each "o" represents a phosphodiester internucleoside linkage.

The nucleobase sequences of SEQ ID Nos: 2475, 2552, 2629, 2706, 2783, 3627-3630, and 3644 are complementary within nucleobases 446679-446706 of SEQ ID NO: 2.

The nucleobase sequence of Compound Nos.: 1041926-1041930, 1364282, 1365258-1365261, 1365282-1365284, 1365287, and 1394522 are complementary within nucleobases 446679-446706 of SEQ ID NO: 2.

In certain embodiments, modified oligonucleotides complementary within nucleobases 446679-446706 of SEQ ID NO: 2 achieve at least 67% reduction of ATXN1 RNA in vitro in the standard cell assay. In certain embodiments, modified oligonucleotides complementary within nucleobases 446679-446706 of SEQ ID NO: 2.achieve an average of 81% reduction of ATXN1 RNA in vitro in the standard cell assay.

6. Additional Hotspot Regions

In certain embodiments, the ranges described in the Table below comprise hotspot regions. Each hotspot region begins with the nucleobase of SEQ ID NO:1 identified in the "Start Site SEQ ID NO: 1" column and ends with the nucleobase of SEQ ID NO: 1 identified in the "Stop Site SEQ ID NO: 1" column. In certain embodiments, modified oligonucleotides are complementary within any of the hotspot regions 1-53, as defined in the table below. In certain embodiments, modified oligonucleotides are 17 nucleobases in length. In certain embodiments, modified oligonucleotides are 20 nucleobases in length.

In certain embodiments, the gapmers are 5-10-5 MOE gapmers. In certain embodiments, the gapmers are 6-10-4 MOE gapmers. In certain embodiments, the gapmers are 5-8-4 MOE gapmers or 5-8-4 mixed MOE/cEt gapmers. In certain embodiments, the mixed wing gapmers have the sugar motif in order from 5' to 3': eeeeedddddddddkkee; wherein 'd' represents a 2'-β-D-deoxyribosyl sugar moiety, 'k' represents a cEt sugar moiety, and 'e' represents a 2'-MOE sugar moiety. In certain embodiments, gapmers comprise a 2'-substituted nucleoside in the gap. In certain embodiments, the 2'-substituted nucleoside comprises a 2'-OMe sugar moiety. In certain embodiments, the 2'-substituted nucleoside is at position 2 of the gap (5' to 3'). In certain embodiments, the gapmers have the sugar motif in order from 5' to 3': eeeeedyddddddddeeeee or eeeeedyddddddkkee; wherein 'd' represents a 2'-β-D-deoxyribosyl sugar moiety, 'k' represents a cEt sugar moiety, 'e' represents a 2'-MOE sugar moiety, and "y" represents a 2'-OMe sugar moiety.

In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in order from 5' to 3': In certain embodiments, modified nucleotides have an internucleoside linkage motif of sooossssssssssssooss, sssossssssssssssosss, sssosssssssss-soss, or sooooosssssssssssoss wherein each "s" represents a phosphorothioate internucleoside linkage and each "o" represents a phosphodiester internucleoside linkage.

The nucleobase sequence of compounds listed in the "Compound No. in range" column in the table below are complementary to SEQ ID NO: 2 within the specified hotspot region. The nucleobase sequence of the oligonucleotides listed in the "SEQ ID NO: in range" column in the table below are complementary to the target sequence, SEQ ID NO: 2, within the specified hotspot region.

In certain embodiments, modified oligonucleotides complementary to nucleobases within the hotspot region achieve at least "Min.% Red. in vitro" (minimum % reduction, relative to untreated control cells) of ATXN1 RNA in vitro in the standard cell assay, as indicated in the table below. In certain embodiments, modified oligonucleotides complementary to nucleobases within the hotspot region achieve an average of "Avg.% Red. in vitro" (average % reduction, relative to untreated control cells) of ATXN1 RNA in vitro in the standard cell assay, as indicated in the table below. In certain embodiments, modified oligonucleotides complementary to nucleobases within the hotspot region achieve a maximum of "Max. % Red. in vitro" (maximum % reduction, relative to untreated control cells) of ATXN1 RNA in vitro in the standard cell assay, as indicated in the table below. In certain embodiments, modified oligonucleotides complementary to nucleobases within the hotspot region achieve an average of "Avg. % Red. in vivo" (average % reduction, relative to PBS-treated animals) of ATXN1 RNA in vivo in the standard in vivo assay in cortical tissue, as indicated in the table below. Note that due to the transgenic mouse model used, only compounds targeting nucleosides 435531-464889 of SEQ ID NO: 2 were tested in vivo; "n.d." indicates that no in vivo data are available for compounds within that range. In other cases, average reduction in vivo includes a subset of the compounds in any given hotspot, as not all compounds were tested in vivo.

TABLE 1

ATXN1 Hotspots

| Hot spot ID | SEQ ID NO: 1 Start Site | SEQ ID NO: 1 Stop Site | SEQ ID NO: 2 Start Site | SEQ ID NO: 2 Stop Site | Min. % Red. in vitro | Max. % Red. in vitro | Avg. % Red. in vitro | Avg. % Red. in vivo (ctx) | Compound No. in range | SEQ ID NO in range |
|---|---|---|---|---|---|---|---|---|---|---|
| 1 | 5477 | 5552 | 459730 | 459805 | 58 | 96 | 90 | 54 | 994446-994450, 1040296-1040301, 1055001-1055011, 1342062, 1342067, 1365271, 1365272, 1365274, 1365294, 1365299-1365300, 1371818, 1371827, 1371829, 1371837, 1371843, 1371871, 1371876, 1385293, 1394156-1394160, 1394162, 1394164, 1394166-1394168, 1394533, 1394544, 1394546, 1394549, 1394553 | 196, 274, 352, 430, 508, 2578, 2655, 2732, 2809, 2886, 2963, 3121, 3122, 3190-3192, 3262, 3330-3332, 3401, 3402, 3575, 3577, 3620, 3624, 3638-3640, 3653-3655, 3662, 3665, 3669 |
| 2 | 5906 | 6005 | 460159 | 460258 | 26 | 97 | 78 | 51 | 994458-994463, 1040327-1040333, 1367569, 1367580- | 42, 120, 198, 276, 509, 587, 2502, 2579, |

TABLE 1-continued

ATXN1 Hotspots

| Hot spot ID | SEQ ID NO: 1 Start Site | SEQ ID NO: 1 Stop Site | SEQ ID NO: 2 Start Site | SEQ ID NO: 2 Stop Site | Min. % Red. in vitro | Max. % Red. in vitro | Avg. % Red. in vitro | Avg. % Red. in vivo (ctx) | Compound No. in range | SEQ ID NO in range |
|---|---|---|---|---|---|---|---|---|---|---|
| | | | | | | | | | 1367581, 1367589-1367591, 1371311, 1371820, 1371823, 1371825, 1371842, 1371865, 1371868, 1371870, 1371873, 1371875, 1371877, 1394161, 1394163, 1394165, 1394524, 1394538, 1394541, 1394543, 1394545, 1394548, 1394550-1394552 | 2656, 2733, 2810, 2887, 2964, 3585, 3588-3590, 3615, 3618, 3622, 3657, 3660, 3661, 3663, 3664, 3666-3668 |
| 3 | 7868 | 7911 | 462121 | 462145 | 61 | 94 | 79 | 53 | 994508, 994509, 1040499, 1040450, 1394513, 1394529 | 48, 126, 2044, 2121 |
| 4 | 8481 | 8514 | 462734 | 462767 | 54 | 89 | 79 | 48 | 994525-994527, 1040500-1040503, 1394514, 1394525 | 128, 206, 284, 1045, 1122, 1199, 1276 |
| 5 | N/A | N/A | 446679 | 446706 | 67 | 89 | 81 | 24 | 1041926-1041930, 1364282, 1365258-1365261, 1365282-1365284, 1365287, 1394522 | 2475, 2552, 2629, 2706, 2783, 3627-3630, 3644 |
| 6 | 99 | 140 | 2609 | 2650 | 43 | 90 | 76 | n.d. | 994310-994313, 1054946-1054957 | 179, 257, 335, 413, 3111-3113, 3183, 3253-3254, 3321-3322, 3394-3395, 3464-3465 |
| 7 | 195 | 227 | 9911 | 9943 | 64 | 92 | 78 | n.d. | 994597-994601, 1055055-1055061 | 137, 215, 293, 371, 449, 3131-3132, 3201, 3341-3342, 3410, 3478 |
| 8 | 243 | 275 | 10654 | 10686 | 75 | 93 | 85 | n.d. | 994314, 1054962-1054971 | 491, 3114, 3184-3185, 3255-3256, 3323-3324, 3396, 3466-3467 |
| 9 | 413 | 454 | 106155 | 106196 | 68 | 95 | 86 | n.d. | 994318-994324 | 25, 180, 258, 336, 414, 492, 570 |
| 10 | 500 | 589 | 178110 | 178199 | 60 | 98 | 88 | n.d. | 994325-994328, 1054972-1054984 | 103, 181, 259, 337, 3115-3117, 3186-3187, 3257-3258, 3325-3326, 3397-3398, 3468-3469 |
| 11 | 587 | 619 | N/A | N/A | 80 | 99 | 94 | n.d. | 994329, 1054990-1054999 | 415, 3119, 3188-3189, 3260-3261, 3328-3329, 3400, 3471-3472 |
| 12 | 3984 | 4031 | 458237 | 458284 | 77 | 95 | 83 | 24 | 994408-994409, 1040170-1040173 | 347, 425, 2728, 2805, 2882, 2959, 3036 |
| 13 | 4434 | 4457 | 458687 | 458710 | 88* | 88* | 88* | 49 | 994419, 1342032, 1364280, 1365267, 1365268, 1365270, 1365290-1365292, 1365298, 1371322, 1371325, 1371809, 1371824, 1371851, | 582, 3563, 3593, 3605, 3621, 3635-3637, 3648-3649, 3652, 3656, 3658-3659 |

TABLE 1-continued

ATXN1 Hotspots

| Hot spot ID | SEQ ID NO: 1 Start Site | SEQ ID NO: 1 Stop Site | SEQ ID NO: 2 Start Site | SEQ ID NO: 2 Stop Site | Min. % Red. in vitro | Max. % Red. in vitro | Avg. % Red. in vitro | Avg. % Red. in vivo (ctx) | Compound No. in range | SEQ ID NO in range |
|---|---|---|---|---|---|---|---|---|---|---|
| | | | | | | | | | 1371854, 1371872, 1385295, 1394153-1394155, 1394534, 1394537, 1394539, 1394540, 1394547 | |
| 14 | 4497 | 4553 | 458750 | 458806 | 48 | 91 | 78 | 25 | 1040205-1040211 | 651, 728, 805, 882, 959, 2960, 3037 |
| 15 | 4586 | 4640 | 458839 | 458893 | 63 | 99 | 87 | 50 | 994420-994422, 1040212-1040215 | 37, 115, 193, 1036, 1113, 1190, 1267 |
| 16 | 4725 | 4786 | 458978 | 459039 | 24 | 98 | 77 | 33 | 994429-994430, 1040222-1040239, 1342061, 1342064, 1342069, 1342071, 1342074-1342076, 1364283, 1365262-1356265, 1365285-1365286, 1365288-1365289, 1371808, 1371810, 1371813, 1371815-1371816, 1371819, 1371822, 1371844-1371845, 1371848, 1371853, 1385294, 1394507, 1394511, 1394518, 1394523, 1394527 | 116, 194, 652, 1806, 1883, 1960, 2037, 2114, 2191, 2268, 2345, 2422, 2499, 2576, 2653, 2730, 2807, 2884, 2961, 3038, 3558, 3560-3562, 3574, 3576, 3578, 3592, 3594, 3597, 3604, 3631-3635, 3645, 3646-3647 |
| 17 | 6015 | 6099 | 460268 | 460352 | 58 | 94 | 78 | 34 | 994464-994469, 1040334-1040344, 1055012-1055023, 1342039, 1342041, 1342044, 1342046, 1342048 | 43, 121, 354, 1432, 510, 588, 655, 732, 809, 886, 963, 1040, 1117, 1194, 1271, 1348, 3041, 3123-3125, 3193-3194, 3263-3264, 3333-3334, 3403, 3473-3474, 3541, 3543, 3545, 3565, 3569 |
| 18 | 6919 | 6960 | 461172 | 461213 | 90 | 96 | 93 | 50 | 994484, 1040382-1040384 | 45, 1811, 1888, 1965 |
| 19 | 7076 | 7114 | 461329 | 461367 | 76 | 98 | 89 | 58 | 994490-994496, 1040393-1040395, 1394166-1394167, 1394516, 1394530 | 46, 124, 202, 280, 358, 513, 591, 2658, 2735, 2812 |
| 20 | 7696 | 7741 | 461949 | 461994 | 74 | 94 | 87 | 29 | 994506, 1040435-1040438 | 515, 966, 1043, 1120, 1197 |
| 21 | 8194 | 8257 | 462447 | 462510 | 58 | 97 | 82 | 37 | 994516-994521, 1040472-1040482, 1394512, 1394517, 1394528, 1394531 | 49, 127, 205, 283, 361, 439, 1352, 1429, 1506, 1583, 1660, 1737, 1814, 1891, 1968, 2045, 2122 |
| 22 | 9181 | 9214 | 463434 | 463467 | 68 | 97 | 82 | 51 | 994549-994551, 1040566-1040567 | 131, 209, 287, 1201, 1278 |
| 23 | 9472 | 9513 | 463725 | 463766 | 79 | 91 | 84 | 25 | 994559-994561, 1055024-1055036 | 288, 366, 444, 3126-3127, 3195-3197, 3265-3266, 3335-3336, 3404-3405, 3475-3476 |
| 24 | 9667 | 9730 | 463920 | 463983 | 75 | 94 | 86 | 35 | 994562-994564, 1040612-1040613 | 55, 522, 600, 2280, 2357 |

TABLE 1-continued

| | ATXN1 Hotspots | | | | | | | | | |
|---|---|---|---|---|---|---|---|---|---|---|
| Hot spot ID | SEQ ID NO: 1 Start Site | SEQ ID NO: 1 Stop Site | SEQ ID NO: 2 Start Site | SEQ ID NO: 2 Stop Site | Min. % Red. in vitro | Max. % Red. in vitro | Avg. % Red. in vitro | Avg. % Red. in vivo (ctx) | Compound No. in range | SEQ ID NO in range |
| 25 | 10095 | 10121 | 464348 | 464374 | 66 | 95 | 84 | 13 | 994571, 1055043-1055048 | 601, 3129, 3199, 3268, 3339, 3407, 3408 |
| 26 | 10133 | 10158 | 464386 | 464411 | 84 | 92 | 88 | n.d. | 994572-994574, 1040633 | 56, 134, 212, 1434 |
| 27 | 10237 | 10277 | 464490 | 464530 | 72 | 90 | 82 | n.d. | 994579-994580, 1040653-1040658 | 57, 602, 665, 742, 819, 896, 2974, 3051 |
| 28 | 10311 | 10353 | 464564 | 464606 | 80 | 95 | 89 | n.d. | 994581-994583 1040663-1040666 | 135, 213, 291, 1281, 1358, 1435, 1512 |
| 29 | N/A | N/A | 439072 | 439126 | 69 | 99 | 87 | 47 | 994809-994811, 1041407-1041414, 1364281, 1365254-1365255, 1365278, 1365281, 1394526 | 475, 553, 631, 1920, 1997, 2074, 2151, 2228, 2305, 2382, 2459, 3625-3626, 3642-3643 |
| 30 | N/A | N/A | 17722 | 17748 | 72 | 99 | 87 | n.d. | 994605, 1055065-1055071 | 138, 3134, 3202-3203, 3270, 3343, 3412, 3480 |
| 31 | N/A | N/A | 85512 | 85545 | 64 | 92 | 76 | n.d. | 994630, 1055084-1055094 | 219, 3137, 3206-3207, 3273-3274, 3346-3347, 3415-3416, 3483-3484 |
| 32 | N/A | N/A | 179779 | 179809 | 43 | 96 | 81 | n.d. | 994690, 1055106-1055113 | 538, 3140, 3210, 3276-3277, 3350, 3419-3420, 3487 |
| 33 | N/A | N/A | 184181 | 184213 | 85 | 99 | 94 | n.d. | 994693, 1055123-1055132 | 149, 3143, 3212-3213, 3280, 3352-3353, 3422-3423, 3490-3491 |
| 34 | N/A | N/A | 203033 | 203066 | 48 | 94 | 76 | n.d. | 994700, 1055137-1055147 | 72, 3144-3145, 3214-3215, 3282-3283, 3355-3356, 3425, 3493-3494 |
| 35 | N/A | N/A | 203889 | 203914 | 81 | 98 | 92 | n.d. | 994701, 1055151-1055156 | 150, 3147, 3285, 3357-3358, 3426, 3495 |
| 36 | N/A | N/A | 210720 | 210755 | 47 | 96 | 80 | n.d. | 994702, 1055157-1055168 | 228, 3148-3149, 3217-3218, 3286-3287, 3359-3360, 3427-3429, 3496 |
| 37 | N/A | N/A | 212027 | 212056 | 69 | 90 | 80 | n.d. | 994703, 1055174-1055182 | 306, 3151-3152, 3220-3221, 3362, 3430-3431, 3498-3499 |
| 38 | N/A | N/A | 217274 | 217309 | 40 | 97 | 73 | n.d. | 994706, 1055186-1055197 | 540, 3153, 3222-3223, 3290-3291, 3364-3365, 3433-3434, 3500-3502 |
| 39 | N/A | N/A | 226995 | 227019 | 75 | 90 | 81 | n.d. | 994713, 1055208-1055212 | 463, 3156, 3226, 3294, 3368, 3436 |

TABLE 1-continued

| | ATXN1 Hotspots | | | | | | | | | |
|---|---|---|---|---|---|---|---|---|---|---|
| Hot spot ID | SEQ ID NO: 1 Start Site | SEQ ID NO: 1 Stop Site | SEQ ID NO: 2 Start Site | SEQ ID NO: 2 Stop Site | Min. % Red. in vitro | Max. % Red. in vitro | Avg. % Red. in vitro | Avg. % Red. in vivo (ctx) | Compound No. in range | SEQ ID NO in range |
| 40 | N/A | N/A | 251500 | 251533 | 68 | 94 | 83 | n.d. | 994717, 1055224-1055234 | 152, 3159-3160, 3229, 3297-3298, 3370-3371, 3439-3440, 3506-3507 |
| 41 | N/A | N/A | 284223 | 284260 | 96 | 99 | 98 | n.d. | 994731, 1055240-1055252 | 621, 3162, 3163, 3231, 3232, 3299, 3300, 3374, 3375, 3442, 3443, 3509, 3510 |
| 42 | N/A | N/A | 284331 | 284370 | 39 | 98 | 88 | n.d. | 994732, 1055253-1055266 | 76, 3164-3166, 3233-3234, 3301-3302. 3376-3377, 3444-3446, 3511-3512 |
| 43 | N/A | N/A | 291004 | 291043 | 93 | 99 | 97 | n.d. | 994734, 1055268-1055281 | 232, 3167-3168, 3236-3237, 3303-3305, 3378-3379, 3447-3449, 3513-3514 |
| 44 | N/A | N/A | 296997 | 297034 | 73 | 99 | 95 | n.d. | 994735, 1055283-1055295 | 310, 3169-3170, 3238-3240, 3306-3307, 3380-3381, 3450-3451, 3516-3517 |
| 45 | N/A | N/A | 306737 | 306769 | 78 | 98 | 92 | n.d. | 994740, 1055300-1055305 | 77, 3171, 3241, 3309, 3383, 3453, 3519 |
| 46 | N/A | N/A | 318484 | 318519 | 88 | 99 | 96 | n.d. | 994743, 1041154, 1055310-1055317 | 311, 2143, 3173-3174, 3243, 3311, 3385, 3454-3455, 3520 |
| 47 | N/A | N/A | 332352 | 332391 | 54 | 99 | 90 | n.d. | 994756, 1055321-1055334 | 79, 3175-3177, 3245-3246, 3313-3314, 3387-3388, 3456-3458, 3521-3522 |
| 48 | N/A | N/A | 347813 | 347852 | 57 | 99 | 84 | n.d. | 994761, 1055337-1055350 | 469, 3178-3179, 3248-3249, 3316-3317, 3389-3391, 3459-3460, 3523-3525 |
| 49 | N/A | N/A | 437786 | 437815 | 74 | 97 | 91 | 12 | 1041316-1041322 | 2302, 2379, 2456, 2533, 2610, 2687, 2764 |
| 50 | N/A | N/A | 439429 | 439463 | 81 | 96 | 87 | 14 | 1041438-1041443, 1342051, 1342058, 1342043, 1342040 | 1844, 1921, 1998, 2075, 2152, 2229, 3547, 3572 |
| 51 | N/A | N/A | 442680 | 442711 | 78 | 93 | 87 | 30 | 1041636-1041639 | 2312, 2389, 2466, 2543 |
| 52 | N/A | N/A | 446727 | 446761 | 74 | 93 | 84 | n.d. | 1041936-1041941 | 782, 859, 936, 1013, 1090, 1167 |

TABLE 1-continued

ATXN1 Hotspots

| Hot spot ID | SEQ ID NO: 1 Start Site | SEQ ID NO: 1 Stop Site | SEQ ID NO: 2 Start Site | SEQ ID NO: 2 Stop Site | Min. % Red. in vitro | Max. % Red. in vitro | Avg. % Red. in vitro | Avg. % Red. in vivo (ctx) | Compound No. in range | SEQ ID NO in range |
|---|---|---|---|---|---|---|---|---|---|---|
| 53 | N/A | N/A | 446925 | 446970 | 59 | 91 | 77 | n.d. | 994871-994873, 1041961-1041966 | 327, 405, 483, 2707, 2784, 2861, 2938, 3015, 3092 |
| 54 | N/A | N/A | 451523 | 451560 | 82 | 95 | 89 | n.d. | 1042239-1042244 | 1946, 2023, 2100, 2177, 2254, 2331 |
| 55 | N/A | N/A | 451681 | 451718 | 72 | 91 | 83 | 0 | 1042253-1042258 | 715, 792, 869, 946, 3024, 3101 |
| 6 | 99 | 140 | 2609 | 2650 | 43 | 90 | 76 | n.d. | 994310-994313, 1054946-1054957 | 179, 257, 335, 413, 3111-3113, 3183, 3253-3254, 3321-3322, 3394-3395, 3464-3465 |

*Only a single compound tested in vitro; see in vivo column for average % reduction.

Nonlimiting Disclosure and Incorporation by Reference

Each of the literature and patent publications listed herein is incorporated by reference in its entirety. While certain compounds, compositions and methods described herein have been described with specificity in accordance with certain embodiments, the following examples serve only to illustrate the compounds described herein and are not intended to limit the same. Each of the references, GenBank accession numbers, and the like recited in the present application is incorporated herein by reference in its entirety.

Although the sequence listing accompanying this filing identifies each sequence as either "RNA" or "DNA" as required, in reality, those sequences may be modified with any combination of chemical modifications. One of skill in the art will readily appreciate that such designation as "RNA" or "DNA" to describe modified oligonucleotides is, in certain instances, arbitrary. For example, an oligonucleotide comprising a nucleoside comprising a 2'-OH sugar moiety and a thymine base could be described as a DNA having a modified sugar (2'-OH in place of one 2'-H of DNA) or as an RNA having a modified base (thymine (methylated uracil) in place of an uracil of RNA). Accordingly, nucleic acid sequences provided herein, including, but not limited to those in the sequence listing, are intended to encompass nucleic acids containing any combination of natural or modified RNA and/or DNA, including, but not limited to such nucleic acids having modified nucleobases. By way of further example and without limitation, an oligomeric compound having the nucleobase sequence "ATCGATCG" encompasses any oligomeric compounds having such nucleobase sequence, whether modified or unmodified, including, but not limited to, such compounds comprising RNA bases, such as those having sequence "AUCGAUCG" and those having some DNA bases and some RNA bases such as "AUCGATCG" and oligomeric compounds having other modified nucleobases, such as "AT$^m$CGAUCG," wherein $^m$C indicates a cytosine base comprising a methyl group at the 5-position.

Certain compounds described herein (e.g., modified oligonucleotides) have one or more asymmetric center and thus give rise to enantiomers, diastereomers, and other stereoisomeric configurations that may be defined, in terms of absolute stereochemistry, as (R) or (S), as α or β such as for sugar anomers, or as (D) or (L), such as for amino acids, etc. Compounds provided herein that are drawn or described as having certain stereoisomeric configurations include only the indicated compounds. Compounds provided herein that are drawn or described with undefined stereochemistry include all such possible isomers, including their stereorandom and optically pure forms, unless specified otherwise. Likewise, tautomeric forms of the compounds herein are also included unless otherwise indicated. Unless otherwise indicated, compounds described herein are intended to include corresponding salt forms.

The compounds described herein include variations in which one or more atoms are replaced with a non-radioactive isotope or radioactive isotope of the indicated element. For example, compounds herein that comprise hydrogen atoms encompass all possible deuterium substitutions for each of the $^1$H hydrogen atoms. Isotopic substitutions encompassed by the compounds herein include but are not limited to: $^2$H or $^3$H in place of $^1$H, $^{13}$C or $^{14}$C in place of $^{12}$C, $^{15}$N in place of $^{14}$N, $^{17}$O or $^{18}$O in place of $^{16}$O, and $^{33}$S, $^{34}$S, $^{35}$S, or $^{36}$S in place of $^{32}$S. In certain embodiments, non-radioactive isotopic substitutions may impart new properties on the oligomeric compound that are beneficial for use as a therapeutic or research tool. In certain embodiments, radioactive isotopic substitutions may make the compound suitable for research or diagnostic purposes such as imaging.

Under certain conditions, certain compounds disclosed herein act as acids. Although such compounds may be drawn or described in protonated (free acid) form, or ionized and in association with a cation (salt) form, aqueous solutions of such compounds exist in equilibrium among such forms. For example, a phosphodiester linkage of an oligonucleotide in aqueous solution exists in equilibrium among free acid, anion and salt forms. Unless otherwise indicated, compounds described herein are intended to include all such forms. Moreover, certain oligonucleotides have several such linkages, each of which is in equilibrium. Thus, oligonucleotides in solution exist in an ensemble of forms at multiple positions all at equilibrium. The term "oligonucleotide" is intended to include all such forms. Drawn structures necessarily depict a single form. Nevertheless, unless otherwise indicated, such drawings are likewise intended to include corresponding forms. Herein, a structure depicting the free acid of a compound followed by the term "or a salt thereof" expressly includes all such forms that may be fully or partially protonated/de-protonated/in association with a cation. In certain instances, one or more specific cation is identified. In certain embodiments, modified oligonucleotides or oligomeric compounds are in aqueous solution with sodium. In certain embodiments, modified oligonucleotides or oligomeric compounds are in aqueous solution with potassium. In certain embodiments, modified oligonucleotides or oligomeric compounds are in PBS. In certain embodiments, modified oligonucleotides or oligomeric compounds are in water. In certain such embodiments, the pH of the solution is adjusted with NaOH and/or HCl to achieve a desired pH.

Herein, certain specific doses are described. A dose may be in the form of a dosage unit. For clarity, a dose (or dosage unit) of a modified oligonucleotide or an oligomeric compound in milligrams indicates the mass of the free acid form of the modified oligonucleotide or oligomeric compound. As described above, in aqueous solution, the free acid is in equilibrium with anionic and salt forms. However, for the purpose of calculating dose, it is assumed that the modified oligonucleotide or oligomeric compound exists as a solvent-free, sodium-acetate free, anhydrous, free acid. For example, where a modified oligonucleotide or an oligomeric compound is in solution comprising sodium (e.g., saline), the modified oligonucleotide or oligomeric compound may be partially or fully de-protonated and in association with Na+ ions. However, the mass of the protons are nevertheless counted toward the weight of the dose, and the mass of the Na+ ions are not counted toward the weight of the dose. Thus, for example, a dose, or dosage unit, of 10 mg of Compound No. 1371311, equals the number of fully protonated molecules that weighs 10 mg. This would be equivalent to 10.59 mg of solvent-free, sodium acetate-free, anhydrous sodiated Compound No. 1371311. When an oligomeric compound comprises a conjugate group, the mass of the conjugate group is included in calculating the dose of such oligomeric compound. If the conjugate group also has an acid, the conjugate group is likewise assumed to be fully protonated for the purpose of calculating dose.

EXAMPLES

Example 1: Effect of 5-10-5 MOE Gapmer Modified Oligonucleotides on Human ATXN1 RNA In Vitro, Single Dose Modified oligonucleotides complementary to human ATXN1 nucleic acid were designed and tested for their single dose effects on ATXN1 mRNA in vitro. The modified oligonucleotides were tested in a series of experiments that had similar culture conditions.

The modified oligonucleotides in the tables below are 5-10-5 MOE gapmers with mixed PO/PS internucleoside linkages. The gapmers are 20 nucleosides in length, wherein the central gap segment consists of ten 2'-β-D-deoxynucleosides and the 3' and 5' wings each consist of five 2'-MOE modified nucleosides. The motif for the gapmers is (from 5' to 3'): eeeeedddddddddeeeee; wherein "d" represents a 2'-β-D-deoxyribosyl sugar, and 'e' represents a 2'-MOE modified ribosyl sugar. The internucleoside linkage motif for the gapmers is (from 5' to 3'): sooosssssssssssooss; wherein 'o' represents a phosphodiester internucleoside linkage and 's' represents a phosphorothioate internucleoside linkage. Each cytosine residue is a 5-methyl cytosine.

"Start site" indicates the 5'-most nucleoside to which the modified oligonucleotide is complementary in the human gene sequence. "Stop site" indicates the 3'-most nucleoside to which the modified oligonucleotide is complementary in the human gene sequence. Each modified oligonucleotide listed in the Tables below is 100% complementary to SEQ ID NO: 1 (GENBANK Accession No. NM_000332.3), or SEQ ID NO: 2 (the complement of GENBANK Accession No. NC_000006.12 truncated from nucleotides 16296001 to 16764000). 'N/A' indicates that the modified oligonucleotide is not 100% complementary to that particular gene sequence.

Cultured A-431 cells were treated with modified oligonucleotide at a concentration of 4,000 nM by free uptake at a density of 10,000 cells per well for a treatment period of 48 hours. At the end of their treatment period, total RNA was isolated from the cells and ATXN1 RNA levels were measured by quantitative real-time RTPCR. ATXN1 RNA levels were measured by Human ATXN1 primer probe set RTS37573 (forward sequence CATCCAGAGTGCAGAGATAAGC, designated herein as SEQ ID NO: 11; reverse sequence ACTCTACCAAAACTT-CAACGCT, designated herein as SEQ ID NO: 12; probe sequence AGAGGATTGAAGACAGCCATAGCC, designated herein as SEQ ID NO: 13). ATXN1 RNA levels were normalized to total RNA content, as measured by RIBOGREEN®. Results are presented in the tables below as percent ATXN1 RNA levels relative to untreated control cells (% control). Each table represents results from an individual assay plate. The Compound No. marked with an asterisk (*) indicates that the modified oligonucleotide is complementary to the amplicon region of the primer probe set. Additional assays may be used to measure the potency and efficacy of the modified oligonucleotides complementary to the amplicon region.

TABLE 2

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994308 | 6 | 25 | 2516 | 2535 | CTGCGGTATACTCTGCTCTC | 96 | 23 |
| 994316 | 305 | 324 | 1076 | 10735 | GGAGGAGGAGATTGCTGTAC | 13 | 24 |
| 994324 | 435 | 454 | 106177 | 106196 | GTGCAGGCTGAAATCCACTC | 32 | 25 |

TABLE 2-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994332 | 691 | 710 | 277909 | 277928 | GTGTTCTTTCTTCCTTTCAC | 37 | 26 |
| 994340 | 959 | 978 | 435678 | 435697 | ATTTCATTTTTCGCCGTCCC | 53 | 27 |
| 994348 | 1190 | 1209 | 435909 | 435928 | CTTTGTGTAAACCTATTCCC | 29 | 28 |
| 994356 | 1881 | 1900 | 436600 | 436619 | TCAGCTTTCTTGGTGGCCTC | 103 | 29 |
| 994364 | 2264 | 2283 | 436983 | 437002 | GTGTGGTCTGAATGACCGTG | 76 | 30 |
| 994372 | 2728 | 2747 | 437447 | 437466 | GTCTTCCACCTTCTTTAGCT | 65 | 31 |
| 994380* | 2816 | 2835 | 437535 | 437554 | GGCTGTCTTCAATCCTCTCT | 4 | 32 |
| 994388 | 3139 | 3158 | 457392 | 457411 | TCCGTTTTCCTGCTCGGCAT | 32 | 33 |
| 994396 | 3398 | 3417 | 457651 | 457670 | ACTTGCCTACATTAGACCGG | 30 | 34 |
| 994404 | 3630 | 3649 | 457883 | 457902 | ACCGCTCCTGCTGTGCCCTT | 35 | 35 |
| 994412 | 4246 | 4265 | 458499 | 458518 | CGCTCTCTCCCTCTCCCCCA | 55 | 36 |
| 994420 | 4617 | 4636 | 458870 | 458889 | TGTTTTGTTTTTTCCCCAA | 2 | 37 |
| 994428 | 4708 | 4727 | 458961 | 458980 | ATTGAAACTTTCAATATCTT | 50 | 38 |
| 994436 | 4858 | 4877 | 459111 | 459130 | CCCTTTTCTCTCAGTTTCTC | 37 | 39 |
| 994444 | 5428 | 5447 | 459681 | 459700 | TTTTTTTTAAAGCACTTTAA | 73 | 40 |
| 994452 | 5560 | 5579 | 459813 | 459832 | GATTTTTTTTTAATTTGTG | 72 | 41 |
| 994460 | 5980 | 5999 | 460233 | 460252 | TGTGTGTTTTTCTGAGTCCA | 4 | 42 |
| 994468 | 6050 | 6069 | 460303 | 460322 | GTGTTTTCCCATCTTAGTGT | 7 | 43 |
| 994476 | 6324 | 6343 | 460577 | 460596 | TGGGAGGCTCTCTCCCTCCT | 86 | 44 |
| 994484 | 6937 | 6956 | 461190 | 461209 | CGGTAAATATTGCAAAGTGG | 4 | 45 |
| 994492 | 7083 | 7102 | 461336 | 461355 | GTTTGTTGGTTTCTTATTAA | 5 | 46 |
| 994500 | 7217 | 7236 | 461470 | 461489 | GGCATCCATCTCTGTATCCC | 34 | 47 |
| 994508 | 7868 | 7887 | 462121 | 462140 | CATTGGAGATTTTCTCTCT | 17 | 48 |
| 994516 | 8196 | 8215 | 462449 | 462468 | TCTCTATTTCAGAAATTCTG | 34 | 49 |
| 994524 | 8379 | 8398 | 462632 | 462651 | ATCTATGTAAAAGAAATCTC | 58 | 50 |
| 994532 | 8542 | 8561 | 462795 | 462814 | AATTTTTTAAAACATTACCT | 57 | 51 |
| 994540 | 8764 | 8783 | 463017 | 463036 | GGTATAGTTTAAGAGCCTTT | 10 | 52 |
| 994548 | 9176 | 9195 | 463429 | 463448 | GCCTCTTTATATTAAATAAA | 76 | 53 |
| 994556 | 9296 | 9315 | 463549 | 463568 | TCTGAATTTAAGAATTGTAA | 52 | 54 |
| 994564 | 9707 | 9726 | 463960 | 463979 | ACCTAATACTTGGTATTCTG | 17 | 55 |
| 994572 | 10133 | 10152 | 464386 | 464405 | GTGTCTGTTTTCCCTTGGCC | 9 | 56 |
| 994580 | 10241 | 10260 | 464494 | 464513 | GTATGCACTTAAAATTTTCT | 11 | 57 |
| 994588 | 10381 | 10400 | 464634 | 464653 | ATAGAATATGAATTCTTCCA | 30 | 58 |
| 994596 | 10613 | 10632 | 464866 | 464885 | ATTGGCACTGTTATTTTATT | 48 | 59 |
| 994604 | N/A | N/A | 15633 | 15652 | GGCTCTTTAAATATTACTCC | 63 | 60 |
| 994612 | N/A | N/A | 31191 | 31210 | GTTTGACTAGATGTGCTTCT | 7 | 61 |
| 994620 | N/A | N/A | 41645 | 41664 | TCTTGAGCTTTTAATTTTAC | 22 | 62 |

TABLE 2-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994628 | N/A | N/A | 72785 | 72804 | TGCTCCTTTTATCATTGTCA | 16 | 63 |
| 994636 | N/A | N/A | 94229 | 94248 | CGGTGGTTTGTTGTACCCTT | 62 | 64 |
| 994644 | N/A | N/A | 111441 | 111460 | TGTACTCTATAATTTTTAA | 82 | 65 |
| 994652 | N/A | N/A | 134750 | 134769 | TGAGCTGCTTTTCATATTCT | 28 | 66 |
| 994660 | N/A | N/A | 148412 149523 | 148431 149542 | CAATAGACAAAAATTATCAT | 78 | 67 |
| 994668 | N/A | N/A | 148748 149859 | 148767 149878 | TTTCCGAAGCTGCTATATGT | 63 | 68 |
| 994676 | N/A | N/A | 155724 | 155743 | GTCTCTCTTTTTCTAAGTCA | 46 | 69 |
| 994684 | N/A | N/A | 169830 170088 | 169849 170107 | AGACTAATATATATATATAT | 52 | 70 |
| 994692 | N/A | N/A | 180504 | 180523 | GGGTCTCTTCATCTACCTTC | 61 | 71 |
| 994700 | N/A | N/A | 203037 | 203056 | TGTTCCTTTCTTCTTTGTTC | 21 | 72 |
| 994708 | N/A | N/A | 219463 | 219482 | GGGTGTGTATTCAATTCTCT | 59 | 73 |
| 994716 | N/A | N/A | 250181 | 250200 | GTGACTTTAAAGCTTTCCTG | 53 | 74 |
| 994724 | N/A | N/A | 269848 269877 | 269867 269896 | ACTGAGAGGCATCTCCAGTG | 86 | 75 |
| 994732 | N/A | N/A | 284341 | 284360 | TGTCAACTAGTTCTTATCAC | 7 | 76 |
| 994740 | N/A | N/A | 306740 306826 | 306759 306845 | GGTAAGGGCCACTAAATCTG | 5 | 77 |
| 994748 | N/A | N/A | 322467 323729 | 322486 323748 | CTTACCACAGAGACATGCCC | 56 | 78 |
| 994756 | N/A | N/A | 332362 | 332381 | GGAGTATTATAACAATTTGC | 5 | 79 |
| 994764 | N/A | N/A | 354092 | 354111 | GTCTGGGCTGATGATGCTGG | 16 | 80 |
| 994772 | N/A | N/A | 369873 | 369892 | GTCTGCCTTTAACATTTTTC | 25 | 81 |
| 994780 | N/A | N/A | 386759 | 386778 | TGTTGTTTATAAGTTTACGG | 12 | 82 |
| 994788 | N/A | N/A | 406846 | 406865 | TGCAGCTTATTTTATAGGTG | 8 | 83 |
| 994796 | N/A | N/A | 422947 | 422966 | CGGTGTCTTAATATCCTCAG | 32 | 84 |
| 994804 | N/A | N/A | 437891 | 437910 | GTTCCTCATCTTAATCACAG | 24 | 85 |
| 994812 | N/A | N/A | 439175 | 439194 | GTGACTCATCTTGGCTACAG | 32 | 86 |
| 994820 | N/A | N/A | 440213 | 440232 | ATTTTCCATGTGTCACCTGG | 34 | 87 |
| 994828 | N/A | N/A | 441396 | 441415 | GTGCAGTGTCAGCAGTGCCT | 44 | 88 |
| 994836 | N/A | N/A | 443271 | 443290 | GTTGTCTTACTGATCTGGAG | 12 | 89 |
| 994844 | N/A | N/A | 444292 | 444311 | TGAGACCTCTCTCTACTTGC | 43 | 90 |
| 994852 | N/A | N/A | 445329 | 445348 | TCAGTCCTTGGTGGAAGTGT | 50 | 91 |
| 994860 | N/A | N/A | 445809 | 445828 | TCTGTTGTTTAAATATGTCT | 49 | 92 |
| 994868 | N/A | N/A | 446320 | 446339 | TCTTTCATCTCTGGATGCCC | 42 | 93 |
| 994876 | N/A | N/A | 447587 | 447606 | GTGTTCTATCTCCAGAGTCT | 20 | 94 |
| 994884 | N/A | N/A | 448144 | 448163 | TGGTGAAGATAATGATGATC | 28 | 95 |

TABLE 2-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994892 | N/A | N/A | 449029 | 449048 | TCCAGTTTTAATAAAAGTTC | 61 | 96 |
| 994900 | N/A | N/A | 451116 | 451135 | ATTTTACTTAATTTTTACAA | 77 | 97 |
| 994908 | N/A | N/A | 452370 | 452389 | ATGTGCATATATACATAGAC | 23 | 98 |
| 994916 | N/A | N/A | 453097 | 453116 | CTTTTCTACTTCATCTTCTT | 61 | 99 |
| 994924 | N/A | N/A | 455432 | 455451 | GTGTTCTCTGGTGAGCCCCA | 59 | 100 |

TABLE 3

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994309 | 23 | 42 | 2533 | 2552 | TGTAGTAGAAATGATGTCTG | 75 | 101 |
| 994317 | 368 | 387 | 106110 | 106129 | AAATAGACTCTTTCACTATG | 41 | 102 |
| 994325 | 500 | 519 | 178110 | 178129 | GTGGCAGTGGAGAATCTCAG | 10 | 103 |
| 994333 | 761 | 780 | 277979 | 277998 | TCAGCCTATACTTCACCATG | 40 | 104 |
| 994341 | 965 | 984 | 435684 | 435703 | GGTTGGATTTCATTTTTCGC | 17 | 105 |
| 994349 | 1363 | 1382 | 436082 | 436101 | TCCACTGTATTGGGAGGACC | 73 | 106 |
| 994357 | 1882 | 1901 | 436601 | 436620 | CTCAGCTTTCTTGGTGGCCT | 93 | 107 |
| 994365 | 2455 | 2474 | 437174 | 437193 | CGCTTCCATGTCAGTGCTGC | 62 | 108 |
| 994373 | 2739 | 2758 | 437458 | 437477 | TCTGTTTTAAGTCTTCCAC | 35 | 109 |
| 994381* | 2848 | 2867 | 437567 | 437586 | GGCGAACTGTATCACGGCCA | 49 | 110 |
| 994389 | 3147 | 3166 | 457400 | 457419 | TGGTTGATTCCGTTTTCCTG | 63 | 111 |
| 994397 | 3467 | 3486 | 457720 | 457739 | CCTACAGTACAGTAATCTGG | 32 | 112 |
| 994405 | 3750 | 3769 | 458003 | 458022 | CACGGGACTTTTCTCCTGAC | 49 | 113 |
| 994413 | 4249 | 4268 | 458502 | 458521 | GTTCGCTCTCTCCCTCTCCC | 13 | 114 |
| 994421 | 4618 | 4637 | 458871 | 458890 | TTGTTTTTGTTTTTTCCCCA | 1 | 115 |
| 994429 | 4759 | 4778 | 459012 | 459031 | CATTTATTGTCACATACTAG | 19 | 116 |
| 994437 | 4922 | 4941 | 459175 | 459194 | GGTTCTTTAAAAGTTCATCT | 2 | 117 |
| 994445 | 5429 | 5448 | 459682 | 459701 | CTTTTTTTTAAAGCACTTTA | 37 | 118 |
| 994453 | 5571 | 5590 | 459824 | 459843 | GGTTGATACCAGATTTTTTT | 19 | 119 |
| 994461 | 5981 | 6000 | 460234 | 460253 | GTGTGTGTTTTTCTGAGTCC | 6 | 120 |
| 994469 | 6054 | 6073 | 460307 | 460326 | ATGTGTGTTTTCCCATCTTA | 8 | 121 |
| 994477 | 6421 | 6440 | 460674 | 460693 | GTCTCCTTGGCTGGCTCTTT | 21 | 122 |
| 994485 | 7018 | 7037 | 461271 | 461290 | GTGTTCCATTGTAAACGCAA | 36 | 123 |
| 994493 | 7087 | 7106 | 461340 | 461359 | TCTTGTTTGTTGGTTTCTTA | 3 | 124 |
| 994501 | 7243 | 7262 | 461496 | 461515 | TCCACTTTAAAAGATCTGAG | 18 | 125 |
| 994509 | 7892 | 7911 | 462145 | 462164 | GCACGGTATTAGTGTCTTCA | 6 | 126 |

TABLE 3-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994517 | 8204 | 8223 | 462457 | 462476 | TCTTAAATTCTCTATTTCAG | 34 | 127 |
| 994525 | 8487 | 8506 | 462740 | 462759 | TCTTCAGCTTCTCAAATCAG | 46 | 128 |
| 994533 | 8648 | 8667 | 462901 | 462920 | TCTGCTTTTTTTTTTTACA | 45 | 129 |
| 994541 | 8867 | 8886 | 463120 | 463139 | AAGTACTTTCAGCATAGGAA | 13 | 130 |
| 994549 | 9189 | 9208 | 463442 | 463461 | CGTATTTATTCTGGCCTCTT | 14 | 131 |
| 994557 | 9428 | 9447 | 463681 | 463700 | AATACAGTTGAACCATTTGT | 28 | 132 |
| 994565 | 9725 | 9744 | 463978 | 463997 | ACAGCTTGAGCTAGTGTCAC | 32 | 133 |
| 994573 | 10135 | 10154 | 464388 | 464407 | TGGTGTCTGTTTTCCCTTGG | 16 | 134 |
| 994581 | 10311 | 10330 | 464564 | 464583 | GGAATTACAGAGAGTATGCA | 11 | 135 |
| 994589 | 10506 | 10525 | 464759 | 464778 | GTTTTATTATAATAATGAAA | 76 | 136 |
| 994597 | 198 | 217 | 9914 | 9933 | GTAGTAGTTTTTGTGAGGTA | 14 | 137 |
| 994605 | N/A | N/A | 17726 | 17745 | GTCACCTTTTCTATTTGCAC | 6 | 138 |
| 994613 | N/A | N/A | 33070 | 33089 | ATTTTGACTTTTGATTGGTG | 12 | 139 |
| 994621 | N/A | N/A | 44962 44984 | 44981 45003 | GGGACTCTGTCTTTATTTCC | 75 | 140 |
| 994629 | N/A | N/A | 77141 | 77160 | ATGTTTCTATCTAAGTCCCA | 40 | 141 |
| 994637 | N/A | N/A | 98148 | 98167 | GTGTGCATTTTTAATTTTGT | 55 | 142 |
| 994645 | N/A | N/A | 112180 | 112199 | TGAGGACATCATGATGGTGC | 20 | 143 |
| 994653 | N/A | N/A | 139451 | 139470 | GTTTTGTTTCAGTATTAGGT | 3 | 144 |
| 994661 | N/A | N/A | 148441 149552 | 148460 149571 | TACATCCTGAAAATCACAGC | 42 | 145 |
| 994669 | N/A | N/A | 148797 149908 | 148816 149927 | CTCTCACTTTTCTTCTCCTT | 59 | 146 |
| 994677 | N/A | N/A | 157700 | 157719 | GTCTCCTTACATAGTGCTGC | 42 | 147 |
| 994685 | N/A | N/A | 169837 169922 | 169856 169941 | ATATATTAGACTAATATATA | 86 | 148 |
| 994693 | N/A | N/A | 184184 | 184203 | TCAGGTTTATATGTATACAA | 7 | 149 |
| 994701 | N/A | N/A | 203893 | 203912 | GTTTGTTTAGATTTATCCTC | 5 | 150 |
| 994709 | N/A | N/A | 219913 | 219932 | GTCATAGCTCTCCTCTGCAC | 46 | 151 |
| 994717 | N/A | N/A | 251504 | 251523 | GTCAGCATACTTAGCTTTTC | 16 | 152 |
| 994725 | N/A | N/A | 269857 269886 | 269876 269905 | CAGGGCTGGACTGAGAGGCA | 58 | 153 |
| 994733 | N/A | N/A | 288893 | 288912 | TGAGACTATTATAGTTTCCA | 12 | 154 |
| 994741 | N/A | N/A | 308086 308110 | 308105 308129 | TAAAATGCACCAATCAACGC | 38 | 155 |
| 994749 | N/A | N/A | 328172 | 328191 | GTTACTTTATTTCTCTAGGG | 10 | 156 |
| 994757 | N/A | N/A | 333463 | 333482 | ATTTGTCTTGTTGTATGTTG | 15 | 157 |
| 994765 | N/A | N/A | 355633 | 355652 | GTTATTTTAAATAGTGGCCT | 65 | 158 |
| 994773 | N/A | N/A | 369913 | 369932 | TCTTTGGCTTTTAGACCTGT | 35 | 159 |

TABLE 3-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994781 | N/A | N/A | 390011 | 390030 | ATGTTATATCAATGTTCTGT | 6 | 160 |
| 994789 | N/A | N/A | 413612 | 413631 | GTCTCAGCTCAAGAGTCTGT | 75 | 161 |
| 994797 | N/A | N/A | 430371 | 430390 | TGGCCTGTATATCTATGGAC | 75 | 162 |
| 994805 | N/A | N/A | 438153 | 438172 | TCAGCCATAGCTCACTACAG | 26 | 163 |
| 994813 | N/A | N/A | 439396 | 439415 | GTCCCATTTGAATGTTTTCA | 15 | 164 |
| 994821 | N/A | N/A | 440225 | 440244 | TCACTCATGTTTATTTTCCA | 58 | 165 |
| 994829 | N/A | N/A | 441413 | 441432 | TCTGAATTTCTCTGTGGGTG | 11 | 166 |
| 994837 | N/A | N/A | 443454 | 443473 | TGTACTCTTCAGAGAAGCTG | 64 | 167 |
| 994845 | N/A | N/A | 444302 | 444321 | GTTAGGTGTGTGAGACCTCT | 61 | 168 |
| 994853 | N/A | N/A | 445380 | 445399 | TCTGTGAGTGTTCTATTTAA | 27 | 169 |
| 994861 | N/A | N/A | 445876 | 445895 | TGGTGCTATGTCTATATACA | 25 | 170 |
| 994869 | N/A | N/A | 446356 | 446375 | TGGCCTTTATACTTTTGTAA | 92 | 171 |
| 994877 | N/A | N/A | 447624 | 447643 | TGTATATTTGTCTGTTTTGC | 9 | 172 |
| 994885 | N/A | N/A | 448318 | 448337 | CTTCCTTTTTTATTTTGAG | 17 | 173 |
| 994893 | N/A | N/A | 449699 | 449718 | TCTTTATTTTATAATTAGGT | 63 | 174 |
| 994901 | N/A | N/A | 451209 | 451228 | TCTATGGTCCTCAGTCTCCT | 57 | 175 |
| 994909 | N/A | N/A | 452421 | 452440 | GTGACACTATTTGGTTTCAA | 59 | 176 |
| 994917 | N/A | N/A | 453098 | 453117 | GCTTTTCTACTTCATCTTCT | 59 | 177 |
| 994925 | N/A | N/A | 455497 | 455516 | TGGGCTTTTGATAGTGTTAA | 20 | 178 |

TABLE 4

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994310 | 99 | 118 | 2609 | 2628 | GTTGCTCTGGCTGCTGCTCC | 23 | 179 |
| 994318 | 413 | 432 | 106155 | 106174 | TCTCTCTTGTTCCTGGTCTG | 9 | 180 |
| 994326 | 515 | 534 | 178125 | 178144 | GCTTGAGTAGAAAGGGTGGC | 40 | 181 |
| 994334 | 879 | 898 | 435598 | 435617 | GTCACATTTGATTTCTGTAG | 12 | 182 |
| 994342 | 966 | 985 | 435685 | 435704 | TGGTTGGATTTCATTTTTCG | 24 | 183 |
| 994350 | 1550 | 1569 | 436269 | 436288 | GCTGCTGCTGCTCAGCCTTG | 62 | 184 |
| 994358 | 1889 | 1908 | 436608 | 436627 | GGCTGCTCTCAGCTTTCTTG | 89 | 185 |
| 994366 | 2554 | 2573 | 437273 | 437292 | GTTGAAGTTCTCGCTCTTGG | 23 | 186 |
| 994374 | 2740 | 2759 | 437459 | 437478 | TTCTGTTTTTAAGTCTTCCA | 30 | 187 |
| 994382* | 2849 | 2868 | 437568 | 437587 | CGGCGAACTGTATCACGGCC | 30 | 188 |
| 994390 | 3154 | 3173 | 457407 | 457426 | ACTCCCCTGGTTGATTCCGT | 54 | 189 |
| 994398 | 3481 | 3500 | 457734 | 457753 | CTGTGTTATTTTAGCCTACA | 5 | 190 |

TABLE 4-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994406 | 3932 | 3951 | 458185 | 458204 | GTTCCTGATGTTGATTTTGC | 27 | 191 |
| 994414 | 4251 | 4270 | 458504 | 458523 | GTGTTCGCTCTCTCCCTCTC | 24 | 192 |
| 994422 | 4621 | 4640 | 458874 | 458893 | TTTTTGTTTTTGTTTTTTCC | 14 | 193 |
| 994430 | 4762 | 4781 | 459015 | 459034 | GGTCATTTATTGTCACATAC | 2 | 194 |
| 994438 | 4971 | 4990 | 459224 | 459243 | ACTGCAGGAATATCACACAA | 54 | 195 |
| 994446 | 5485 | 5504 | 459738 | 459757 | GTTTAGTTGCAGCCATCCAA | 8 | 196 |
| 994454 | 5572 | 5591 | 459825 | 459844 | GGGTTGATACCAGATTTTTT | 29 | 197 |
| 994462 | 5983 | 6002 | 460236 | 460255 | TGGTGTGTGTTTTTCTGAGT | 7 | 198 |
| 994470 | 6121 | 6140 | 460374 | 460393 | ATTTTATAATTCCTATACCT | 74 | 199 |
| 994478 | 6470 | 6489 | 460723 | 460742 | CATTCACTATTCCGTGTGGT | 41 | 200 |
| 994486 | 7024 | 7043 | 461277 | 461296 | GTGATTGTGTTCCATTGTAA | 5 | 201 |
| 994494 | 7088 | 7107 | 461341 | 461360 | TTCTTGTTTGTTGGTTTCTT | 5 | 202 |
| 994502 | 7384 | 7403 | 461637 | 461656 | TCACAATTCCAAGTTAGAAA | 16 | 203 |
| 994510 | 7930 | 7949 | 462183 | 462202 | GTACCGAGAGCTCTGCTTCC | 54 | 204 |
| 994518 | 8208 | 8227 | 462461 | 462480 | GTGTTCTTAAATTCTCTATT | 3 | 205 |
| 994526 | 8492 | 8511 | 462745 | 462764 | TGTTTTCTTCAGCTTCTCAA | 18 | 206 |
| 994534 | 8649 | 8668 | 462902 | 462921 | CTCTGCTTTTTTTTTTTAC | 45 | 207 |
| 994542 | 8893 | 8912 | 463146 | 463165 | GTTTAGACTAAGAAGGGAGC | 22 | 208 |
| 994550 | 9191 | 9210 | 463444 | 463463 | TCCGTATTTATTCTGGCCTC | 32 | 209 |
| 994558 | 9462 | 9481 | 463715 | 463734 | AGATACTACCTATTGGCCAA | 63 | 210 |
| 994566 | 9758 | 9777 | 464011 | 464030 | GCACCGAGCTTCTTGGTAAC | 60 | 211 |
| 994574 | 10139 | 10158 | 464392 | 464411 | GTTCTGGTGTCTGTTTTCCC | 8 | 212 |
| 994582 | 10328 | 10347 | 464581 | 464600 | GTACAATATTTTACACTGGA | 5 | 213 |
| 994590 | 10548 | 10567 | 464801 | 464820 | ATTTATTTAAAACAATTTTG | 86 | 214 |
| 994598 | 201 | 220 | 9917 | 9936 | CTTGTAGTAGTTTTGTGAG | 36 | 215 |
| 994606 | N/A | N/A | 18215 18273 | 18234 18292 | GGAGGGTGCTTAGTCCTTCC | 69 | 216 |
| 994614 | N/A | N/A | 34101 355035 | 34120 355054 | GTTTGGCACACAGTAGGTGC | 29 | 217 |
| 994622 | N/A | N/A | 46490 | 46509 | GTGACTGCTGCTGATACCTG | 39 | 218 |
| 994630 | N/A | N/A | 85516 | 85535 | GTTTGATATGCTATGCTCAC | 26 | 219 |
| 994638 | N/A | N/A | 98883 | 98902 | TGTTTGGTTGAAGTATGTGG | 30 | 220 |
| 994646 | N/A | N/A | 115266 | 115285 | ATGTGGGTATTTAATGTTTC | 17 | 221 |
| 994654 | N/A | N/A | 140695 | 140714 | GTCTTTCTAAATGGTTGTAC | 31 | 222 |
| 994662 | N/A | N/A | 148489 149600 | 148508 149619 | TTCAGCATGATCTCAGTTCT | 25 | 223 |
| 994670 | N/A | N/A | 148889 150000 | 148908 150019 | ATGACATAATTCTAATAACT | 58 | 224 |

TABLE 4-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994678 | N/A | N/A | 159922 | 159941 | TCTCCTTATCTTGTCCTCTC | 47 | 225 |
| 994686 | N/A | N/A | 169926 170006 | 169945 170025 | TATTATATATTAGACTAATA | 81 | 226 |
| 994694 | N/A | N/A | 185906 | 185925 | GTTCTATTTTATAATAGTAG | 70 | 227 |
| 994702 | N/A | N/A | 210730 | 210749 | TGTGTAATACTCCATTTTTC | 18 | 228 |
| 994710 | N/A | N/A | 223261 | 223280 | GTTTGTGTTGTGTTTTACAG | 19 | 229 |
| 994718 | N/A | N/A | 251771 | 251790 | GTTTTCATACACAGTTCTTC | 23 | 230 |
| 994726 | N/A | N/A | 270287 | 270306 | ATTATATTACATTATACTTG | 100 | 231 |
| 994734 | N/A | N/A | 291014 | 291033 | TCCTGGGTTTTTAGTTTTCC | 4 | 232 |
| 994742 | N/A | N/A | 310465 | 310484 | TGAGGATTACATCAGTGTAA | 4 | 233 |
| 994750 | N/A | N/A | 328842 | 328861 | TCTTGGGTAGATGAGGTTTG | 11 | 234 |
| 994758 | N/A | N/A | 337233 | 337252 | TCTTGTTTTTCCTTTCTTG | 25 | 235 |
| 994766 | N/A | N/A | 357070 | 357089 | GTCTCCTTTGTTCCGTGTAC | 21 | 236 |
| 994774 | N/A | N/A | 372154 | 372173 | GTCTTTTTATTTCTCTGCCC | 11 | 237 |
| 994782 | N/A | N/A | 396255 396277 | 396274 396296 | TTGCAAGAAGGTATGCCTAG | 61 | 238 |
| 994790 | N/A | N/A | 413815 | 413834 | TCCTGTTTACAACAAAGCTC | 66 | 239 |
| 994798 | N/A | N/A | 430661 | 430680 | TCTTTCTTTGCTATAATTTC | 84 | 240 |
| 994806 | N/A | N/A | 438267 | 438286 | GTCTGCTGATCTATCTGTTG | 20 | 241 |
| 994814 | N/A | N/A | 439492 | 439511 | ATTAGTTTATCTTTTTTTC | 78 | 242 |
| 994822 | N/A | N/A | 440914 | 440933 | CTGTCAGTAGAGAGATTTAG | 41 | 243 |
| 994830 | N/A | N/A | 441421 | 441440 | TGCACATTTCTGAATTTCTC | 13 | 244 |
| 994838 | N/A | N/A | 443819 | 443838 | GTACCAGCTAATCCATTCAA | 43 | 245 |
| 994846 | N/A | N/A | 444486 | 444505 | TGTTCTGTATAATAATGTAA | 60 | 246 |
| 994854 | N/A | N/A | 445456 | 445475 | CGAGAGACCCATTTACTGCA | 16 | 247 |
| 994862 | N/A | N/A | 446068 | 446087 | TGGGCTCATAATTATTTTTT | 71 | 248 |
| 994870 | N/A | N/A | 446878 | 446897 | AAGTCATTTTATGATCTTGC | 55 | 249 |
| 994878 | N/A | N/A | 447631 | 447650 | ATTTACTTGTATATTTGTCT | 12 | 250 |
| 994886 | N/A | N/A | 448328 | 448347 | GTTTCCATAGCTTCCTTTTT | 37 | 251 |
| 994894 | N/A | N/A | 449737 | 449756 | TCTCAAATAGGTACACTCAA | 40 | 252 |
| 994902 | N/A | N/A | 451578 | 451597 | TTTTGTTTAAAGGGTTTTAC | 85 | 253 |
| 994910 | N/A | N/A | 452423 | 452442 | GTGTGACACTATTTGGTTTC | 49 | 254 |
| 994918 | N/A | N/A | 453104 | 453123 | ATTGTTGCTTTTCTACTTCA | 73 | 255 |
| 994926 | N/A | N/A | 455500 | 455519 | AAGTGGGCTTTTGATAGTGT | 20 | 256 |

TABLE 5

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994311 | 103 | 122 | 2613 | 2632 | TGCTGTTGCTCTGGCTGCTG | 62 | 257 |
| 994319 | 417 | 436 | 106159 | 106178 | TCTTTCTCTCTTGTTCCTGG | 5 | 258 |
| 994327 | 533 | 552 | 178143 | 178162 | TCTTTTCACGAAGATTTTGC | 22 | 259 |
| 994335 | 881 | 900 | 435600 | 435619 | AAGTCACATTTGATTTCTGT | 31 | 260 |
| 994343 | 969 | 988 | 435688 | 435707 | TCTTGGTTGGATTTCATTTT | 31 | 261 |
| 994351 | 1634 | 1653 | 436353 | 436372 | TGAGGTGCTGCTGCTGCTGC | 15 | 262 |
| 994359 | 1904 | 1923 | 436623 | 436642 | TGGCCTGCTGCAGCCGGCTG | 82 | 263 |
| 994367 | 2555 | 2574 | 437274 | 437293 | GGTTGAAGTTCTCGCTCTTG | 14 | 264 |
| 994375 | 2742 | 2761 | 437461 | 437480 | TCTTCTGTTTTAAGTCTTC | 30 | 265 |
| 994383 | 2952 | 2971 | 457205 | 457224 | TGGCTGGTTCTCTCCGGACA | 71 | 266 |
| 994391 | 3245 | 3264 | 457498 | 457517 | TGCTGGGTTCTATTTTGGTG | 38 | 267 |
| 994399 | 3490 | 3509 | 457743 | 457762 | ATGTAAATACTGTGTTATTT | 32 | 268 |
| 994407 | 3933 | 3952 | 458186 | 458205 | GGTTCCTGATGTTGATTTG | 33 | 269 |
| 994415 | 4254 | 4273 | 458507 | 458526 | TGGGTGTTCGCTCTCTCCCT | 37 | 270 |
| 994423 | 4636 | 4655 | 458889 | 458908 | AAAGCAACTTAGTTTTTTTT | 46 | 271 |
| 994431 | 4774 | 4793 | 459027 | 459046 | GTAGTACTTGGTGGTCATTT | 67 | 272 |
| 994439 | 5033 | 5052 | 459286 | 459305 | TGCTACATTTATTTATGCTC | 36 | 273 |
| 994447 | 5491 | 5510 | 459744 | 459763 | TGTTCAGTTTAGTTGCAGCC | 4 | 274 |
| 994455 | 5593 | 5612 | 459846 | 459865 | AATACTAGACAGCCAAAATG | 34 | 275 |
| 994463 | 5986 | 6005 | 460239 | 460258 | AGGTGGTGTGTGTTTTTCTG | 4 | 276 |
| 994471 | 6124 | 6143 | 460377 | 460396 | ATTATTTTATAATTCCTATA | 79 | 277 |
| 994479 | 6535 | 6554 | 460788 | 460807 | TCCAGGCTACATGGCTCCAG | 27 | 278 |
| 994487 | 7056 | 7075 | 461309 | 461328 | ATTTTTTTCTTTTCGCCCTG | 21 | 279 |
| 994495 | 7091 | 7110 | 461344 | 461363 | AGGTTCTTGTTTGTTGGTTT | 2 | 280 |
| 994503 | 7392 | 7411 | 461645 | 461664 | ATAGAGGCTCACAATTCCAA | 12 | 281 |
| 994511 | 8000 | 8019 | 462253 | 462272 | TGTTGAGCTGCTTGTGGTTC | 63 | 282 |
| 994519 | 8212 | 8231 | 462465 | 462484 | TGATGTGTTCTTAAATTCTC | 24 | 283 |
| 994527 | 8495 | 8514 | 462748 | 462767 | TTTTGTTTTCTTCAGCTTCT | 19 | 284 |
| 994535 | 8651 | 8670 | 462904 | 462923 | TTCTCTGCTTTTTTTTTTTT | 44 | 285 |
| 994543 | 8984 | 9003 | 463237 | 463256 | CAAGATTATATTCTTTGGGT | 11 | 286 |
| 994551 | 9194 | 9213 | 463447 | 463466 | TGCTCCGTATTTATTCTGGC | 3 | 287 |
| 994559 | 9472 | 9491 | 463725 | 463744 | GTTATTGTATAGATACTACC | 17 | 288 |
| 994567 | 9841 | 9860 | 464094 | 464113 | GCACTAACTAAAGGATTTAC | 14 | 289 |
| 994575 | 10146 | 10165 | 464399 | 464418 | AACCCAAGTTCTGGTGTCTG | 32 | 290 |
| 994583 | 10334 | 10353 | 464587 | 464606 | GTGCAAGTACAATATTTTAC | 5 | 291 |
| 994591 | 10601 | 10620 | 464854 | 464873 | ATTTTATTAGTACGAGTATA | 41 | 292 |
| 994599 | 204 | 223 | 9920 | 9939 | GTGCTTGTAGTAGTTTTTGT | 30 | 293 |

TABLE 5-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994607 | N/A | N/A | 18221 18279 | 18240 18298 | GTTAGTGGAGGGTGCTTAGT | 24 | 294 |
| 994615 | N/A | N/A | 39140 | 39159 | TCCTGTTATTTTGGTACTGG | 24 | 295 |
| 994623 | N/A | N/A | 47154 | 47173 | GTTTGCCTACTCCTGGTCTG | 28 | 296 |
| 994631 | N/A | N/A | 85766 | 85785 | GTTGACTATCTTATTTTTTC | 20 | 297 |
| 994639 | N/A | N/A | 99612 | 99631 | TCTTGCTTTTAATTTTTTTG | 37 | 298 |
| 994647 | N/A | N/A | 117178 | 117197 | GTTCACCTACATGTTTCCCC | 16 | 299 |
| 994655 | N/A | N/A | 144856 | 144875 | TCTTTTTTTTTAATTACAG | 79 | 300 |
| 994663 | N/A | N/A | 148529 149640 | 148548 149659 | TGGTGCACTCAGCTCTACCT | 62 | 301 |
| 994671 | N/A | N/A | 148965 150076 | 148984 150095 | AAAAATCCTGATCAAAAAAA | 76 | 302 |
| 994679 | N/A | N/A | 160587 | 160606 | GGCTCCATACTCCATTCTGT | 40 | 303 |
| 994687 | N/A | N/A | 170194 | 170213 | TGTATAATATTCCATTCTGT | 48 | 304 |
| 994695 | N/A | N/A | 185938 | 185957 | ATTTTATTACATTTTTCTTG | 77 | 305 |
| 994703 | N/A | N/A | 212031 | 212050 | TCTATGTTAGTCATTTCTCT | 98 | 306 |
| 994711 | N/A | N/A | 223958 | 223977 | TCTTGACATGATGTTTCCCT | 60 | 307 |
| 994719 | N/A | N/A | 256280 | 256299 | ATTACCTTAAAACTACCTTG | 54 | 308 |
| 994727 | N/A | N/A | 271835 271877 | 271854 271896 | TAAGCCATGCCTGGACTTCG | 55 | 309 |
| 994735 | N/A | N/A | 297005 | 297024 | GTTTGCATTAAATGACTGTG | 2 | 310 |
| 994743 | N/A | N/A | 318485 | 318504 | TGTTTGATATTTCTTTTTTT | 10 | 311 |
| 994751 | N/A | N/A | 328883 | 328902 | TCTTGGGTAACTAGATGATG | 15 | 312 |
| 994759 | N/A | N/A | 341935 | 341954 | GTTTTTTTTTTATTTGCCT | 4 | 313 |
| 994767 | N/A | N/A | 357089 | 357108 | GTCAGGTTATAATGACCCTG | 49 | 314 |
| 994775 | N/A | N/A | 376249 | 376268 | TCTTCTGTATTTAATTCTTC | 11 | 315 |
| 994783 | N/A | N/A | 396693 | 396712 | GTTATTGTGTTTATATTCAG | 10 | 316 |
| 994791 | N/A | N/A | 414662 | 414681 | TGGTGACATCTTGTTTCTAC | 15 | 317 |
| 994799 | N/A | N/A | 433785 | 433804 | TGAGCCACTGTGTGTAGCCA | 52 | 318 |
| 994807 | N/A | N/A | 438269 | 438288 | TTGTCTGCTGATCTATCTGT | 25 | 319 |
| 994815 | N/A | N/A | 439696 | 439715 | GTTTTTATTTTAAATTAG | 62 | 320 |
| 994823 | N/A | N/A | 441090 | 441109 | CCTTGCACTTTGTTTCTAC | 7 | 321 |
| 994831 | N/A | N/A | 442195 | 442214 | TCAGTACATGTTCATCTTAA | 10 | 322 |
| 994839 | N/A | N/A | 443918 | 443937 | CGGCATGTTCAATGTTGGCA | 14 | 323 |
| 994847 | N/A | N/A | 444822 | 444841 | GTGAGCTATTATGGTGTCAC | 101 | 324 |
| 994855 | N/A | N/A | 445546 | 445565 | GTCTGCTTTCCTGGAAGGCT | 37 | 325 |
| 994863 | N/A | N/A | 446159 | 446178 | ATCCCCTAAATCGACTCCT | 63 | 326 |
| 994871 | N/A | N/A | 446925 | 446944 | GTTATTTTCTCTCCACTCTC | 33 | 327 |

TABLE 5-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994879 | N/A | N/A | 447641 | 447660 | ATTCTTTTTATTTACTTGT | 43 | 328 |
| 994887 | N/A | N/A | 448332 | 448351 | TCTAGTTTCCATAGCTTCCT | 17 | 329 |
| 994895 | N/A | N/A | 450049 | 450068 | TCTTTGTTTCTTTTTGCCTA | 9 | 330 |
| 994903 | N/A | N/A | 451583 | 451602 | TCCATTTTGTTTAAAGGGT | 25 | 331 |
| 994911 | N/A | N/A | 452493 | 452512 | TGGTACAGATAATTGTGATG | 29 | 332 |
| 994919 | N/A | N/A | 453190 | 453209 | TGGATTTTATACACATTCAG | 49 | 333 |
| 994927 | N/A | N/A | 456737 | 456756 | CTTAGATTTTATGAGCTCAA | 21 | 334 |

TABLE 6

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994312 | 105 | 124 | 2615 | 2634 | GCTGCTGTTGCTCTGGCTGC | 46 | 335 |
| 994320 | 418 | 437 | 106160 | 106179 | CTCTTTCTCTCTTGTTCCTG | 7 | 336 |
| 994328 | 562 | 581 | 178172 | 178191 | ACCATAAGCTATCAGTTCCT | 8 | 337 |
| 994336 | 916 | 935 | 435635 | 435654 | GTCTGGATGGCTCTGATTTT | 39 | 338 |
| 994344 | 974 | 993 | 435693 | 435712 | TCCGCTCTTGGTTGGATTTC | 63 | 339 |
| 994352 | 1637 | 1656 | 436356 | 436375 | TGCTGAGGTGCTGCTGCTGC | 31 | 340 |
| 994360 | 1927 | 1946 | 436646 | 436665 | GTTCAGGACCTCCTTGGCCT | 69 | 341 |
| 994368 | 2560 | 2579 | 437279 | 437298 | CTCAGGGTTGAAGTTCTCGC | 36 | 342 |
| 994376* | 2758 | 2777 | 437477 | 437496 | TGCACTCTGGATGAAATCTT | 34 | 343 |
| 994384 | 3025 | 3044 | 457278 | 457297 | CTTCAGGTTCTTGAGGGTAA | 33 | 344 |
| 994392 | 3248 | 3267 | 457501 | 457520 | GCTTGCTGGGTTCTATTTTG | 93 | 345 |
| 994400 | 3546 | 3565 | 457799 | 457818 | CCTGCTGTAACTCTAATGAC | 40 | 346 |
| 994408 | 3987 | 4006 | 458240 | 458259 | TGGTTAACTTTCCAAATCTG | 16 | 347 |
| 994416 | 4283 | 4302 | 458536 | 458555 | GTTTTCCTAACACTGCACAG | 23 | 348 |
| 994424 | 4661 | 4680 | 458914 | 458933 | ATGTAGTTACAGTGTTGAAA | 5 | 349 |
| 994432 | 4777 | 4796 | 459030 | 459049 | CAGGTAGTACTTGGTGGTCA | 76 | 350 |
| 994440 | 5037 | 5056 | 459290 | 459309 | ATTTGCTACATTTATTTAT | 53 | 351 |
| 994448 | 5496 | 5515 | 459749 | 459768 | GTATTTGTTCAGTTTAGTTG | 5 | 352 |
| 994456 | 5682 | 5701 | 459935 | 459954 | GCTATTCTAAACCTATTCAA | 75 | 353 |
| 994464 | 6029 | 6048 | 460282 | 460301 | GGTTTAGTGGATCCAGTCAA | 7 | 354 |
| 994472 | 6143 | 6162 | 460396 | 460415 | AAGTGTTTAGAAAGAACCAA | 41 | 355 |
| 994480 | 6702 | 6721 | 460955 | 460974 | TGGCAGGTGGTCCCCTCCAC | 68 | 356 |
| 994488 | 7064 | 7083 | 461317 | 461336 | ATAGTATTATTTTTTCTTT | 68 | 357 |
| 994496 | 7095 | 7114 | 461348 | 461367 | AGAGAGGTTCTTGTTTGTTG | 6 | 358 |

TABLE 6-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994504 | 7447 | 7466 | 461700 | 461719 | TGCTGCCACTTCCTGGTGGG | 87 | 359 |
| 994512 | 8003 | 8022 | 462256 | 462275 | GTCTGTTGAGCTGCTTGTGG | 32 | 360 |
| 994520 | 8230 | 8249 | 462483 | 462502 | CTCTGTATATTTATTACTTG | 5 | 361 |
| 994528 | 8496 | 8515 | 462749 | 462768 | ATTTTGTTTTCTTCAGCTTC | 34 | 362 |
| 994536 | 8653 | 8672 | 462906 | 462925 | CCTTCTCTGCTTTTTTTTTT | 73 | 363 |
| 994544 | 8987 | 9006 | 463240 | 463259 | GTTCAAGATTATATTCTTTG | 21 | 364 |
| 994552 | 9235 | 9254 | 463488 | 463507 | GTCCGGCTTGATTTTTGGAC | 78 | 365 |
| 994560 | 9477 | 9496 | 463730 | 463749 | TTGTTGTTATTGTATAGATA | 21 | 366 |
| 994568 | 9935 | 9954 | 464188 | 464207 | TTTAGAGTTGAGCAGTTCAG | 20 | 367 |
| 994576 | 10167 | 10186 | 464420 | 464439 | TGTCAGTCTGGTAGTGCCCT | 18 | 368 |
| 994584 | 10362 | 10381 | 464615 | 464634 | ATTTTTTAATATTTGTTTAA | 75 | 369 |
| 994592 | 10604 | 10623 | 464857 | 464876 | GTTATTTTATTAGTACGAGT | 25 | 370 |
| 994600 | 205 | 224 | 9921 | 9940 | GGTGCTTGTAGTAGTTTTTG | 27 | 371 |
| 994608 | N/A | N/A | 22131 | 22150 | TCCTCCTTTTATATCTGTTT | 72 | 372 |
| 994616 | N/A | N/A | 39208 | 39227 | GTTTGATTACTGTCATGACT | 36 | 373 |
| 994624 | N/A | N/A | 51696 51749 | 51715 51768 | GTGAAAAGAAAGATGTACTT | 82 | 374 |
| 994632 | N/A | N/A | 85767 | 85786 | CGTTGACTATCTTATTTTTT | 26 | 375 |
| 994640 | N/A | N/A | 103358 | 103377 | TCTCAATTATAATTTGTTTT | 71 | 376 |
| 994648 | N/A | N/A | 118549 | 118568 | GTTTCCTTAAAAGCAACTGT | 24 | 377 |
| 994656 | N/A | N/A | 148250 149361 | 148269 149380 | AGAGTCAATGATTAAATTCA | 29 | 378 |
| 994664 | N/A | N/A | 148584 149695 | 148603 149714 | CATGACTCTTTCTTAAGAAT | 49 | 379 |
| 994672 | N/A | N/A | 149011 150122 | 149030 150141 | AAATTTTCTAGAAACATTAA | 60 | 380 |
| 994680 | N/A | N/A | 160737 | 160756 | GTTACCATTCTCCTTTCCCC | 50 | 381 |
| 994688 | N/A | N/A | 170872 170939 | 170891 170958 | TGCTAGCTACAGAGCACTGA | 122 | 382 |
| 994696 | N/A | N/A | 188547 | 188566 | CGTTGGATATTTTATTCTTT | 2 | 383 |
| 994704 | N/A | N/A | 213149 | 213168 | ATGTTTGTATTCCATATTTG | 20 | 384 |
| 994712 | N/A | N/A | 224696 | 224715 | TCTTTTCATCTTCAGCTCTG | 50 | 385 |
| 994720 | N/A | N/A | 264945 | 264964 | GTTTGTGCTTTTGGTGTCAC | 14 | 386 |
| 994728 | N/A | N/A | 275360 | 275379 | GTTTGCTTTCTTCATCCTAC | 45 | 387 |
| 994736 | N/A | N/A | 299651 308026 | 299670 308045 | AATCGCAGGGAGGATTGAAA | 47 | 388 |
| 994744 | N/A | N/A | 318885 | 318904 | TGACCTTTATTTGGATCTTG | 26 | 389 |
| 994752 | N/A | N/A | 329899 | 329918 | TGGCATTTATAATATTTGTG | 2 | 390 |
| 994760 | N/A | N/A | 347724 | 347743 | ATTTTCTTAGAAGGATCTCT | 10 | 391 |

TABLE 6-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994768 | N/A | N/A | 359649 | 359668 | GTTTGAACTGAGCATGTTTT | 17 | 392 |
| 994776 | N/A | N/A | 380393 | 380412 | TGGTCATTAGATCATGCTAC | 31 | 393 |
| 994784 | N/A | N/A | 396974 | 396993 | TGTAGCTTTTAGTGACTTTG | 11 | 394 |
| 994792 | N/A | N/A | 415670 | 415689 | ATTTTGGCTTTCCATAGTGT | 44 | 395 |
| 994800 | N/A | N/A | 434146 | 434165 | GTTACTGCTGCTGTGTGGGC | 64 | 396 |
| 994808 | N/A | N/A | 439027 | 439046 | CTAGGATTAGCTAATTCCTA | 78 | 397 |
| 994816 | N/A | N/A | 439709 | 439728 | TCTCTACTAAAATGTTTTTT | 43 | 398 |
| 994824 | N/A | N/A | 441169 | 441188 | GGAGTATTTTAGCTGTGATG | 6 | 399 |
| 994832 | N/A | N/A | 442536 | 442555 | GCTTCCTTTGGTGCACGCAG | 34 | 400 |
| 994840 | N/A | N/A | 444077 | 444096 | GTTTGACATAGTTTCTCTGT | 15 | 401 |
| 994848 | N/A | N/A | 444899 | 444918 | TGGTGTGTACTTGTGGTCCC | 49 | 402 |
| 994856 | N/A | N/A | 445653 | 445672 | GTTTCAGTAAGTATGTCTTG | 11 | 403 |
| 994864 | N/A | N/A | 446193 | 446212 | GTTATAAGAGATCTGCCTAC | 70 | 404 |
| 994872 | N/A | N/A | 446936 | 446955 | ATCACACTTCAGTTATTTTC | 31 | 405 |
| 994880 | N/A | N/A | 447652 | 447671 | TCTTCTTATGCATTCTTTTT | 29 | 406 |
| 994888 | N/A | N/A | 448391 | 448410 | CCACCCACTGTCCTTTTCAG | 58 | 407 |
| 994896 | N/A | N/A | 450077 | 450096 | ATTCTTCTTTAATCACTTCA | 55 | 408 |
| 994904 | N/A | N/A | 452108 | 452127 | GTTTGCTTATTCTTGCCCAA | 11 | 409 |
| 994912 | N/A | N/A | 452497 | 452516 | TCCATGGTACAGATAATTGT | 53 | 410 |
| 994920 | N/A | N/A | 453505 | 453524 | GTTGGATTCTTTTTTTCTTT | 5 | 411 |
| 994928 | N/A | N/A | 456851 | 456870 | TCTATAGCTGGTCTCTGTTA | 54 | 412 |

TABLE 7

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994313 | 111 | 130 | 2621 | 2640 | CTTGCGGCTGCTGTTGCTCT | 28 | 413 |
| 994321 | 419 | 438 | 106161 | 106180 | ACTCTTTCTCTCTTGTTCCT | 7 | 414 |
| 994329 | 590 | 609 | 178200 | 178219 | GTACCATGTGCTTTCATCAC | 11 | 415 |
| 994337 | 924 | 943 | 435643 | 435662 | GTTTCACTGTCTGGATGGCT | 21 | 416 |
| 994345 | 977 | 996 | 435696 | 435715 | TGCTCCGCTCTTGGTTGGAT | 57 | 417 |
| 994353 | 1693 | 1712 | 436412 | 436431 | GTACTGGTTCTGCTGGGCTG | 32 | 418 |
| 994361 | 1949 | 1968 | 436668 | 436687 | GCCGGCTCTTCTCCATCTCA | 87 | 419 |
| 994369 | 2720 | 2739 | 437439 | 437458 | CCTTCTTTAGCTCCCCGTTG | 48 | 420 |
| 994377* | 2768 | 2787 | 437487 | 437506 | TGCTTATCTCTGCACTCTGG | 6 | 421 |
| 994385 | 3034 | 3053 | 457287 | 457306 | AGAGCCGTTCTTCAGGTTCT | 90 | 422 |

TABLE 7-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994393 | 3279 | 3298 | 457532 | 457551 | GCCGACCACCTCCTCTTCCT | 89 | 423 |
| 994401 | 3568 | 3587 | 457821 | 457840 | TGCACCAGTCTCCTGCGACA | 41 | 424 |
| 994409 | 3999 | 4018 | 458252 | 458271 | TGTTCTTTTAAATGGTTAAC | 17 | 425 |
| 994417 | 4330 | 4349 | 458583 | 458602 | GTTTGCATCTACCTCTTGGG | 14 | 426 |
| 994425 | 4673 | 4692 | 458926 | 458945 | TGCAGAGCTGAAATGTAGTT | 38 | 427 |
| 994433 | 4780 | 4799 | 459033 | 459052 | CGTCAGGTAGTACTTGGTGG | 55 | 428 |
| 994441 | 5069 | 5088 | 459322 | 459341 | AATGGCCTAGAGTTTAGGCA | 81 | 429 |
| 994449 | 5499 | 5518 | 459752 | 459771 | CAGGTATTTGTTCAGTTTAG | 3 | 430 |
| 994457 | 5905 | 5924 | 460158 | 460177 | TCCTCTTACCATCAAAGGCT | 45 | 431 |
| 994465 | 6033 | 6052 | 460286 | 460305 | TGTTGGTTAGTGGATCCAG | 13 | 432 |
| 994473 | 6194 | 6213 | 460447 | 460466 | TGGCACAGAAAGTATTGCAC | 34 | 433 |
| 994481 | 6716 | 6735 | 460969 | 460988 | GTGGTGACCGTGGGTGGCAG | 84 | 434 |
| 994489 | 7075 | 7094 | 461328 | 461347 | GTTTCTTATTAATAGTATTA | 38 | 435 |
| 994497 | 7125 | 7144 | 461378 | 461397 | GTCATTTTATATATTTAGAA | 74 | 436 |
| 994505 | 7454 | 7473 | 461707 | 461726 | GGAGGGATGCTGCCACTTCC | 67 | 437 |
| 994513 | 8005 | 8024 | 462258 | 462277 | CAGTCTGTTGAGCTGCTTGT | 55 | 438 |
| 994521 | 8232 | 8251 | 462485 | 462504 | TTCTCTGTATATTTATTACT | 42 | 439 |
| 994529 | 8503 | 8522 | 462756 | 462775 | CTTCAAAATTTTGTTTTCTT | 38 | 440 |
| 994537 | 8693 | 8712 | 462946 | 462965 | TGACAAATTTCTATATACAA | 66 | 441 |
| 994545 | 9036 | 9055 | 463289 | 463308 | TGAGTCCTGTTTGATTGGTA | 8 | 442 |
| 994553 | 9244 | 9263 | 463497 | 463516 | GTTTCCACTGTCCGGCTTGA | 29 | 443 |
| 994561 | 9486 | 9505 | 463739 | 463758 | TCTTAGAGATTGTTGTTATT | 12 | 444 |
| 994569 | 9942 | 9961 | 464195 | 464214 | ATTTGGGTTTAGAGTTGAGC | 6 | 445 |
| 994577 | 10193 | 10212 | 464446 | 464465 | TCCCTAGTTCTCCTCTGTAC | 74 | 446 |
| 994585 | 10365 | 10384 | 464618 | 464637 | TCCATTTTTAATATTTGTT | 27 | 447 |
| 994593 | 10606 | 10625 | 464859 | 464878 | CTGTTATTTTATTAGTACGA | 42 | 448 |
| 994601 | 206 | 225 | 9922 | 9941 | TGGTGCTTGTAGTAGTTTTT | 33 | 449 |
| 994609 | N/A | N/A | 22231 | 22250 | TCTTCATTTTAATGTTGTTT | 13 | 450 |
| 994617 | N/A | N/A | 39411 | 39430 | TCTGCTCTAAAACTTTCTAC | 55 | 451 |
| 994625 | N/A | N/A | 51702 51755 | 51721 51774 | TTATTAGTGAAAAGAAAGAT | 43 | 452 |
| 994633 | N/A | N/A | 86196 | 86215 | ATTCAGATATAATTGTTTAC | 69 | 453 |
| 994641 | N/A | N/A | 105012 | 105031 | GTGTGAATAACTAATTCCTT | 53 | 454 |
| 994649 | N/A | N/A | 120191 | 120210 | TGTTTGATAAATGTTATTCT | 11 | 455 |
| 994657 | N/A | N/A | 148273 149384 | 148292 149403 | TATTATATTAAAAGTTAAAA | 62 | 456 |
| 994665 | N/A | N/A | 148615 149726 | 148634 149745 | AGAGGCTTCTGGAAATCCCC | 49 | 457 |

TABLE 7-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994673 | N/A | N/A | 149065 150161 | 149084 150180 | CCTGTCTTGATAAAATAAAA | 96 | 458 |
| 994681 | N/A | N/A | 162490 | 162509 | TGCATCTATTTTCTATTCTG | 96 | 459 |
| 994689 | N/A | N/A | 176036 176352 | 176055 176371 | GAAAATTCCTACTCATTTTT | 99 | 460 |
| 994697 | N/A | N/A | 189098 | 189117 | GTTTCTGCTAATCTGTGACA | 31 | 461 |
| 994705 | N/A | N/A | 214840 | 214859 | GTTTGCAGTTAACTTTTTTT | 34 | 462 |
| 994713 | N/A | N/A | 226996 | 227015 | TGGTTATTTACTCATTCTAC | 19 | 463 |
| 994721 | N/A | N/A | 265218 | 265237 | TCTTTTCATAAGCTTATTGG | 71 | 464 |
| 994729 | N/A | N/A | 279331 | 279350 | GTCTGCTTTCAATGAAGCAC | 69 | 465 |
| 994737 | N/A | N/A | 299784 299827 | 299803 299846 | ACTTTCCTGTCTTACAAGAG | 19 | 466 |
| 994745 | N/A | N/A | 320275 | 320294 | GTGAGAACTGCTATTTTCAG | 7 | 467 |
| 994753 | N/A | N/A | 330357 | 330376 | TCAGCTGTACAGCTCCTTAC | 55 | 468 |
| 994761 | N/A | N/A | 347823 | 347842 | TGGTCATTATCTAGTTTCTG | 5 | 469 |
| 994769 | N/A | N/A | 365364 | 365383 | GTGTGTCTAGTTTGTTTTTC | 20 | 470 |
| 994777 | N/A | N/A | 380610 | 380629 | GTTATATATTTCCTATTTTC | 34 | 471 |
| 994785 | N/A | N/A | 398119 | 398138 | TCTATATATTAATCATTTCC | 68 | 472 |
| 994793 | N/A | N/A | 417738 | 417757 | GGGTTATATCATGTTGGCCA | 67 | 473 |
| 994801 | N/A | N/A | 437630 | 437649 | CGGTGTGGTGTCCCATCCCT | 71 | 474 |
| 994809 | N/A | N/A | 439072 | 439091 | CTTTGATATTTAGTGTCTT | 12 | 475 |
| 994817 | N/A | N/A | 440059 | 440078 | TCCTGATTTTCTTTTTTTT | 49 | 476 |
| 994825 | N/A | N/A | 441229 | 441248 | TGCTCTCTGTCTGAGTCTCC | 68 | 477 |
| 994833 | N/A | N/A | 442847 | 442866 | GTGCCAGTTCCTGCATTTTC | 43 | 478 |
| 994841 | N/A | N/A | 444080 | 444099 | GTGGTTTGACATAGTTTCTC | 6 | 479 |
| 994849 | N/A | N/A | 445236 | 445255 | GTTTTTCTTACACATGGTAG | 23 | 480 |
| 994857 | N/A | N/A | 445654 | 445673 | GGTTTCAGTAAGTATGTCTT | 8 | 481 |
| 994865 | N/A | N/A | 446197 | 446216 | TGTGGTTATAAGAGATCTGC | 28 | 482 |
| 994873 | N/A | N/A | 446951 | 446970 | TCATGATTTTATTGAATCAC | 26 | 483 |
| 994881 | N/A | N/A | 447992 | 448011 | TCTTTATACCAGGGATCCCC | 154 | 484 |
| 994889 | N/A | N/A | 448705 | 448724 | TCATACTTTCTTCCGCTCTT | 38 | 485 |
| 994897 | N/A | N/A | 450234 | 450253 | GGGTTTCATTCACCATGTTG | 47 | 486 |
| 994905 | N/A | N/A | 452110 | 452129 | CGGTTTGCTTATTCTTGCCC | 43 | 487 |
| 994913 | N/A | N/A | 452653 | 452672 | ATTTTCTTTTTCTGTGCCT | 9 | 488 |
| 994921 | N/A | N/A | 453506 | 453525 | TGTTGGATTCTTTTTTCTT | 12 | 489 |
| 994929 | N/A | N/A | 456930 | 456949 | TGGGTTGTACCTCTACTTGC | 69 | 490 |

TABLE 8

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994314 | 246 | 265 | 10657 | 10676 | TGGTGACTTGATGCACGATG | 10 | 491 |
| 994322 | 422 | 441 | 106164 | 106183 | TCCACTCTTTCTCTCTTGTT | 17 | 492 |
| 994330 | 687 | 706 | 277905 | 277924 | TCTTTCTTCCTTTCACAGAG | 35 | 493 |
| 994338 | 930 | 949 | 435649 | 435668 | GTGACTGTTTCACTGTCTGG | 79 | 494 |
| 994346 | 980 | 999 | 435699 | 435718 | CGTTGCTCCGCTCTTGGTTG | 47 | 495 |
| 994354 | 1870 | 1889 | 436589 | 436608 | GGTGGCCTCCCGAGGGACAA | 76 | 496 |
| 994362 | 2074 | 2093 | 436793 | 436812 | ATCACGACTGCTGTAGTCTG | 42 | 497 |
| 994370 | 2724 | 2743 | 437443 | 437462 | TCCACCTTCTTTAGCTCCCC | 71 | 498 |
| 994378* | 2771 | 2790 | 437490 | 437509 | CGTTGCTTATCTCTGCACTC | 16 | 499 |
| 994386 | 3115 | 3134 | 457368 | 457387 | GTGTCTGCTGCCCGCCAGGC | 77 | 500 |
| 994394 | 3310 | 3329 | 457563 | 457582 | TTCTGACTTCTCCAGTTTGC | 75 | 501 |
| 994402 | 3618 | 3637 | 457871 | 457890 | GTGCCCTTCCTCCCGCCCGC | 77 | 502 |
| 994410 | 4028 | 4047 | 458281 | 458300 | TTTATTGTAAAATATGTTGG | 71 | 503 |
| 994418 | 4334 | 4353 | 458587 | 458606 | GGCAGTTTGCATCTACCTCT | 19 | 504 |
| 994426 | 4691 | 4710 | 458944 | 458963 | CTTGCTCTTCAGCAATTCTG | 52 | 505 |
| 994434 | 4824 | 4843 | 459077 | 459096 | ATGCCTTGAACTGATTCTCA | 13 | 506 |
| 994442 | 5218 | 5237 | 459471 | 459490 | CTCACATATATAAATGTCTT | 17 | 507 |
| 994450 | 5532 | 5551 | 459785 | 459804 | AAAGTACTATTTTCAATGGG | 23 | 508 |
| 994458 | 5915 | 5934 | 460168 | 460187 | CAGCCCGTATTCCTCTTACC | 19 | 509 |
| 994466 | 6034 | 6053 | 460287 | 460306 | GTGTTGGTTTAGTGGATCCA | 22 | 510 |
| 994474 | 6208 | 6227 | 460461 | 460480 | TGGTCAGACTCTATTGGCAC | 36 | 511 |
| 994482 | 6842 | 6861 | 461095 | 461114 | TGTTTGCTACACAGAAGCGG | 61 | 512 |
| 994490 | 7077 | 7096 | 461330 | 461349 | TGGTTTCTTATTAATAGTAT | 24 | 513 |
| 994498 | 7127 | 7146 | 461380 | 461399 | CAGTCATTTTATATATTTAG | 44 | 514 |
| 994506 | 7707 | 7726 | 461960 | 461979 | GTGCAAAGAGTGGATTTTAT | 6 | 515 |
| 994514 | 8063 | 8082 | 462316 | 462335 | TGGCCCTGTTTTCACCTGGT | 76 | 516 |
| 994522 | 8333 | 8352 | 462586 | 462605 | GTTTGGAGTTTCCCTATGCC | 13 | 517 |
| 994530 | 8509 | 8528 | 462762 | 462781 | TGAGTGCTTCAAAATTTTGT | 42 | 518 |
| 994538 | 8741 | 8760 | 462994 | 463013 | GTAGTAATTCTTCCAGGCCA | 25 | 519 |
| 994546 | 9047 | 9066 | 463300 | 463319 | TGTCCCCATAATGAGTCCTG | 32 | 520 |
| 994554 | 9249 | 9268 | 463502 | 463521 | GTCCAGTTTCCACTGTCCGG | 49 | 521 |
| 994562 | 9685 | 9704 | 463938 | 463957 | GGACAGTATGTTATCTTGGT | 8 | 522 |
| 994570 | 9953 | 9972 | 464206 | 464225 | GGCTGACACTAATTTGGGTT | 22 | 523 |
| 994578 | 10196 | 10215 | 464449 | 464468 | CCTTCCCTAGTTCTCCTCTG | 24 | 524 |
| 994586 | 10367 | 10386 | 464620 | 464639 | CTTCCATTTTTTAATATTTG | 38 | 525 |
| 994594 | 10608 | 10627 | 464861 | 464880 | CACTGTTATTTTATTAGTAC | 77 | 526 |

TABLE 8-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994602 | N/A | N/A | 5488<br>6515 | 5507<br>6534 | ATAAAAGTTGAGTAGCTAGA | 68 | 527 |
| 994610 | N/A | N/A | 28064 | 28083 | TCCGCATTATTTTCCCTGC | 9 | 528 |
| 994618 | N/A | N/A | 40728 | 40747 | TCCTACTTTTAAGTTTCCAG | 10 | 529 |
| 994626 | N/A | N/A | 51710<br>51763 | 51729<br>51782 | AAACTAATTTATTAGTGAAA | 94 | 530 |
| 994634 | N/A | N/A | 86436 | 86455 | TGTATAGTAGAATTTTTTT | 77 | 531 |
| 994642 | N/A | N/A | 106495 | 106514 | GTGTGTTTAGTTGTTTGGGT | 3 | 532 |
| 994650 | N/A | N/A | 122443 | 122462 | GTTGAGACTTAATTGCTCAG | 67 | 533 |
| 994658 | N/A | N/A | 149437<br>148326 | 149456<br>148345 | GAATACTATGTATTTGCCAC | 14 | 534 |
| 994666 | N/A | N/A | 149806<br>148695 | 149825<br>148714 | TTTTGACAAGTCAGTCTTTT | 87 | 535 |
| 994674 | N/A | N/A | 155493 | 155512 | GTTTCCTTAAAATATGTTGG | 9 | 536 |
| 994682 | N/A | N/A | 163871 | 163890 | TCCATTGTATATGTATCTGT | 26 | 537 |
| 994690 | N/A | N/A | 179789 | 179808 | GTTATATTTAATCATGTTCC | 13 | 538 |
| 994698 | N/A | N/A | 189111 | 189130 | GTCATATTTCTTAGTTTCTG | 4 | 539 |
| 994706 | N/A | N/A | 217284 | 217303 | GTTATGTTTAAGGTATTTTC | 21 | 540 |
| 994714 | N/A | N/A | 234290 | 234309 | CGTCGGATAAATTTATCCAC | 80 | 541 |
| 994722 | N/A | N/A | 265414 | 265433 | GTTTTCTATAGTGATTGCAC | 44 | 542 |
| 994730 | N/A | N/A | 281189 | 281208 | TCTTTTTTTCTTTTAACCCT | 6 | 543 |
| 994738 | N/A | N/A | 299793<br>308168 | 299812<br>308187 | CAATCAGGAACTTTCCTGTC | 65 | 544 |
| 994746 | N/A | N/A | 322234<br>323496 | 322253<br>323515 | AGGAACACAAGAGGGAATAC | 53 | 545 |
| 994754 | N/A | N/A | 331549 | 331568 | TCTTTCCTAAAGCTTATTAG | 52 | 546 |
| 994762 | N/A | N/A | 352034 | 352053 | GTTTTAACTCAGCTCTCTCT | 53 | 547 |
| 994770 | N/A | N/A | 366558 | 366577 | CGGCTAGTATTTATATTTTT | 48 | 548 |
| 994778 | N/A | N/A | 382060 | 382079 | GTCTACATTTATAGATTTAG | 11 | 549 |
| 994786 | N/A | N/A | 400669 | 400688 | GTGTTACATAAATTAATTCC | 14 | 550 |
| 994794 | N/A | N/A | 418949 | 418968 | GTTACTGTTCTTATCTTGTG | 47 | 551 |
| 994802 | N/A | N/A | 437850 | 437869 | GGTGAGTTTCTGGATTGTCT | 7 | 552 |
| 994810 | N/A | N/A | 439073 | 439092 | GCTTTGATATTTTAGTGTCT | 6 | 553 |
| 994818 | N/A | N/A | 440092 | 440111 | TGAGCTGTATTATTATGCCA | 68 | 554 |
| 994826 | N/A | N/A | 441272 | 441291 | TCCAGATATGAGTTCTCTCT | 28 | 555 |
| 994834 | N/A | N/A | 442868 | 442887 | GTTCAGACTCAGATCTCTTC | 27 | 556 |
| 994842 | N/A | N/A | 444247 | 444266 | ATAGTCTTTAATTTTTTTCT | 88 | 557 |
| 994850 | N/A | N/A | 445319 | 445338 | GTGGAAGTGTTTCAGGGTTG | 14 | 558 |
| 994858 | N/A | N/A | 445807 | 445826 | TGTTGTTTAAATATGTCTCC | 23 | 559 |

TABLE 8-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994866 | N/A | N/A | 446198 | 446217 | GTGTGGTTATAAGAGATCTG | 27 | 560 |
| 994874 | N/A | N/A | 447042 | 447061 | CAGTGCTTTCTCCAGGGTGT | 3 | 561 |
| 994882 | N/A | N/A | 447995 | 448014 | TCCTCTTTATACCAGGGATC | 47 | 562 |
| 994890 | N/A | N/A | 448758 | 448777 | ATCTCCATAAATGGTATCCC | 37 | 563 |
| 994898 | N/A | N/A | 450475 | 450494 | GGAGAGAGAGAATATTTGAG | 22 | 564 |
| 994906 | N/A | N/A | 452112 | 452131 | TGCGGTTTGCTTATTCTTGC | 14 | 565 |
| 994914 | N/A | N/A | 452981 | 453000 | ACTTGAGTACATTCATATGG | 57 | 566 |
| 994922 | N/A | N/A | 453610 | 453629 | ATCTAGATTGAAGTTTGTAC | 94 | 567 |
| 994930 | N/A | N/A | 456945 | 456964 | TGAGGCTCTTCTCTTTGGGT | 35 | 568 |

TABLE 9

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994315 | 295 | 314 | 10706 | 10725 | ATTGCTGTACAAGGATGACA | 16 | 569 |
| 994323 | 433 | 452 | 106175 | 106194 | GCAGGCTGAAATCCACTCTT | 20 | 570 |
| 994331 | 690 | 709 | 277908 | 277927 | TGTTCTTTCTTCCTTTCACA | 29 | 571 |
| 994339 | 932 | 951 | 435651 | 435670 | CGGTGACTGTTTCACTGTCT | 70 | 572 |
| 994347 | 1068 | 1087 | 435787 | 435806 | CGGTGGTTGTCGCTGGGCAG | 24 | 573 |
| 994355 | 1879 | 1898 | 436598 | 436617 | AGCTTTCTTGGTGGCCTCCC | 91 | 574 |
| 994363 | 2213 | 2232 | 436932 | 436951 | GCTTCCCTAAATGCAGGCCA | 64 | 575 |
| 994371 | 2727 | 2746 | 437446 | 437465 | TCTTCCACCTTCTTTAGCTC | 96 | 576 |
| 994379* | 2812 | 2831 | 437531 | 437550 | GTCTTCAATCCTCTCTACGG | 3 | 577 |
| 994387 | 3127 | 3146 | 457380 | 457399 | CTCGGCATACCTGTGTCTGC | 58 | 578 |
| 994395 | 3313 | 3332 | 457566 | 457585 | GTCTTCTGACTTCTCCAGTT | 47 | 579 |
| 994403 | 3627 | 3646 | 457880 | 457899 | GCTCCTGCTGTGCCCTTCCT | 34 | 580 |
| 994411 | 4046 | 4065 | 458299 | 458318 | ATACAATTAAAAGTTGCTTT | 98 | 581 |
| 994419 | 4436 | 4455 | 458689 | 458708 | ACCCGAGTTGTCCATAGTCA | 12 | 582 |
| 994427 | 4701 | 4720 | 458954 | 458973 | CTTTCAATATCTTGCTCTTC | 25 | 583 |
| 994435 | 4856 | 4875 | 459109 | 459128 | CTTTTCTCTCAGTTTCTCTG | 23 | 584 |
| 994443 | 5219 | 5238 | 459472 | 459491 | GCTCACATATATAAATGTCT | 14 | 585 |
| 994451 | 5557 | 5576 | 459810 | 459829 | TTTTTTTTAATTTGTGAAA | 95 | 586 |
| 994459 | 5979 | 5998 | 460232 | 460251 | GTGTGTTTTCTGAGTCCAC | 3 | 587 |
| 994467 | 6040 | 6059 | 460293 | 460312 | ATCTTAGTGTTGGTTTAGTG | 14 | 588 |
| 994475 | 6231 | 6250 | 460484 | 460503 | TGAGCTTTAACTATATAGCA | 52 | 589 |
| 994483 | 6899 | 6918 | 461152 | 461171 | TGGCTGATCCTTGTAAGCTG | 64 | 590 |

TABLE 9-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994491 | 7080 | 7099 | 461333 | 461352 | TGTTGGTTTCTTATTAATAG | 12 | 591 |
| 994499 | 7151 | 7170 | 461404 | 461423 | TCTTAAGTTAAACATTCTAA | 49 | 592 |
| 994507 | 7839 | 7858 | 462092 | 462111 | ATAGGTTTCCTTAGTAGTCA | 17 | 593 |
| 994515 | 8068 | 8087 | 462321 | 462340 | TCTGCTGGCCCTGTTTTCAC | 23 | 594 |
| 994523 | 8356 | 8375 | 462609 | 462628 | TCCGGAGTAGAGGTGTGCAA | 68 | 595 |
| 994531 | 8510 | 8529 | 462763 | 462782 | GTGAGTGCTTCAAAATTTTG | 34 | 596 |
| 994539 | 8763 | 8782 | 463016 | 463035 | GTATAGTTTAAGAGCCTTTT | 8 | 597 |
| 994547 | 9121 | 9140 | 463374 | 463393 | CATTGAAATCATGTTTTTAC | 23 | 598 |
| 994555 | 9258 | 9277 | 463511 | 463530 | CCCACAGCTGTCCAGTTTCC | 62 | 599 |
| 994563 | 9700 | 9719 | 463953 | 463972 | ACTTGGTATTCTGGAGGACA | 6 | 600 |
| 994571 | 10096 | 10115 | 464349 | 464368 | GGGTAATGATCTGATATTAA | 5 | 601 |
| 994579 | 10239 | 10258 | 464492 | 464511 | ATGCACTTAAAATTTTCTTT | 10 | 602 |
| 994587 | 10368 | 10387 | 464621 | 464640 | TCTTCCATTTTTTAATATTT | 22 | 603 |
| 994595 | 10611 | 10630 | 464864 | 464883 | TGGCACTGTTATTTTATTAG | 41 | 604 |
| 994603 | N/A | N/A | 15303 | 15322 | TGCTCATTAAATAATTGCAG | 57 | 605 |
| 994611 | N/A | N/A | 28526 | 28545 | GTGTCACTAGAAGATGCCCA | 39 | 606 |
| 994619 | N/A | N/A | 41522 | 41541 | GTGCTCACTAATAATAGTCT | 21 | 607 |
| 994627 | N/A | N/A | 71054 | 71073 | TCTCCTCTACTTAAGCTCAG | 42 | 608 |
| 994635 | N/A | N/A | 87298 | 87317 | GTTTCCTATCCTGATTCCCA | 43 | 609 |
| 994643 | N/A | N/A | 106499 | 106518 | GTTTGTGTGTTTAGTTGTTT | 10 | 610 |
| 994651 | N/A | N/A | 127663 | 127682 | GTGACCACTCTCCTCCTCCC | 55 | 611 |
| 994659 | N/A | N/A | 148376 149487 | 148395 149506 | AAGGTTTTCTCTTAAATATT | 54 | 612 |
| 994667 | N/A | N/A | 148746 149857 | 148765 149876 | TCCGAAGCTGCTATATGTCA | 51 | 613 |
| 994675 | N/A | N/A | 155513 | 155532 | GTGTGACACTATTATTCTTT | 27 | 614 |
| 994683 | N/A | N/A | 169801 | 169820 | CGACCTTTAAAATTTTTTCA | 63 | 615 |
| 994691 | N/A | N/A | 180049 | 180068 | ATTTGTTTACTTCTATATTG | 65 | 616 |
| 994699 | N/A | N/A | 198910 | 198929 | GCTTCTTTAAATCTTAGCTC | 72 | 617 |
| 994707 | N/A | N/A | 218665 | 218684 | GTTTGAGTCCAGTGACTTCT | 44 | 618 |
| 994715 | N/A | N/A | 244999 | 245018 | TCTTGAGTTTATCTTTTCTT | 36 | 619 |
| 994723 | N/A | N/A | 269836 269865 269894 | 269855 269884 269913 | CTCCAGTGCAGGGCTGGACT | 86 | 620 |
| 994731 | N/A | N/A | 284231 | 284250 | GTTTGGGTTTTTCTGTACAA | 2 | 621 |
| 994739 | N/A | N/A | 305998 | 306017 | TGGTAGGTATATAGATGTCC | 3 | 622 |
| 994747 | N/A | N/A | 322370 323632 | 322389 323651 | ATCCCAATAAAAACATTCAG | 61 | 623 |
| 994755 | N/A | N/A | 331619 | 331638 | TGTTCCATAGCTCATTTGCA | 8 | 624 |

TABLE 9-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994763 | N/A | N/A | 353740 | 353759 | TGCTGTGTACTTAATTGACA | 41 | 625 |
| 994771 | N/A | N/A | 369407 | 369426 | TCTTGTCTAGTTTTCTGCAG | 54 | 626 |
| 994779 | N/A | N/A | 384151 | 384170 | GTCATTTTTGAACATATCCT | 11 | 627 |
| 994787 | N/A | N/A | 404260 | 404279 | GTCTGTGTACCTCATTCTTT | 13 | 628 |
| 994795 | N/A | N/A | 420137 | 420156 | GTGTGGGTGGCTGTGTCCTG | 70 | 629 |
| 994803 | N/A | N/A | 437851 | 437870 | TGGTGAGTTTCTGGATTGTC | 6 | 630 |
| 994811 | N/A | N/A | 439088 | 439107 | CTTTTATTTTCTGATGCTTT | 7 | 631 |
| 994819 | N/A | N/A | 440165 | 440184 | GTAGTTCATTTTCTTTCTCC | 6 | 632 |
| 994827 | N/A | N/A | 441275 | 441294 | AAGTCCAGATATGAGTTCTC | 25 | 633 |
| 994835 | N/A | N/A | 442870 | 442889 | ATGTTCAGACTCAGATCTCT | 26 | 634 |
| 994843 | N/A | N/A | 444248 | 444267 | AATAGTCTTTAATTTTTTTC | 88 | 635 |
| 994851 | N/A | N/A | 445325 | 445344 | TCCTTGGTGGAAGTGTTTCA | 57 | 636 |
| 994859 | N/A | N/A | 445808 | 445827 | CTGTTGTTTAAATATGTCTC | 15 | 637 |
| 994867 | N/A | N/A | 446255 | 446274 | TCCTCCACTCTTTCCCTCCC | 98 | 638 |
| 994875 | N/A | N/A | 447189 | 447208 | GTTTGCCTTCTGTATGGAAA | 12 | 639 |
| 994883 | N/A | N/A | 448112 | 448131 | TGGAGCCTTGCTATGTTGGC | 59 | 640 |
| 994891 | N/A | N/A | 448954 | 448973 | TGGTTAAGACCTAGTTTCTT | 42 | 641 |
| 994899 | N/A | N/A | 451089 | 451108 | ATTTCTTGAGATGGATTCTC | 24 | 642 |
| 994907 | N/A | N/A | 452123 | 452142 | TCTACCAGAGTTGCGGTTTG | 53 | 643 |
| 994915 | N/A | N/A | 453089 | 453108 | CTTCATCTTCTTTGTTTCCT | 36 | 644 |
| 994923 | N/A | N/A | 455414 | 455433 | CATTCTTTTGAGTTGTGACC | 31 | 645 |
| 994931 | N/A | N/A | 457057 | 457076 | GTTTGATTTTATGCACACAC | 63 | 646 |

Example 2: Effect of 5-10-5 MOE Gapmer Modified Oligonucleotides on Human ATXN1 RNA In Vitro, Single Dose Modified oligonucleotides complementary to human ATXN1 nucleic acid were designed and tested for their single dose effects on ATXN1 mRNA in vitro. The modified oligonucleotides were tested in a series of experiments that had similar culture conditions.

The modified oligonucleotides in the tables below are 5-10-5 MOE gapmers with mixed internucleoside linkages. The gapmers are 20 nucleosides in length, wherein the central gap segment consists of ten 2'-β-D-deoxynucleosides and the 3' and 5' wings each consist of five 2'-MOE modified nucleosides. The motif for the gapmers is (from 5' to 3'): eeeeedddddddddddeeeee; wherein "d" represents a 2'-β-D-deoxyribosyl sugar, and 'e' represents a 2'-MOE modified ribosyl sugar. The internucleoside linkage motif for the gapmers is (from 5' to 3'): sooosssssssssssooss; wherein 'o' represents a phosphodiester internucleoside linkage and 's' represents a phosphorothioate internucleoside linkage. Each cytosine residue is a 5-methyl cytosine.

"Start site" indicates the 5'-most nucleoside to which the modified oligonucleotide is complementary in the human gene sequence. "Stop site" indicates the 3'-most nucleoside to which the modified oligonucleotide is complementary in the human gene sequence. Each modified oligonucleotide listed in the Tables below is 100% complementary to SEQ ID NO: 1, SEQ ID NO: 2, or SEQ ID NO: 3 (GENBANK Accession No. NM_001128164.1). 'N/A' indicates that the modified oligonucleotide is not 100% complementary to that particular gene sequence.

Cultured A-431 cells were treated with modified oligonucleotide at a concentration of 4,000 nM by free uptake at a density of 10,000 cells per well for a treatment period of 48 hours. At the end of their treatment period, total RNA was isolated from the cells and ATXN1 RNA levels were measured by quantitative real-time RTPCR. ATXN1 RNA levels were measured by Human ATXN1 primer probe set RTS37575 (forward sequence GTATAGGCTGAGGC-TACCTGT, designated herein as SEQ ID NO: 14; reverse sequence GATCCAGGCTCTTCATGAGG, designated herein as SEQ ID NO: 15; probe sequence ACAGCAGCTCTGGATGAACATTCACT, designated herein as SEQ ID NO: 16). ATXN1 RNA levels were normalized to total RNA content, as measured by RIBOGREEN®. Results are presented in the tables below as percent ATXN1 RNA levels relative to untreated control cells (% Control). The Compound No. marked with an asterisk (*) indicates that the modified oligonucleotide is complementary to the amplicon region of the primer probe set. Additional assays may be used to measure the potency and efficacy of the modified oligonucleotides complementary to the amplicon region.

TABLE 10

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 4 | 138 |
| 1040079 | 468 | 487 | N/A | N/A | AGACCAAAAACCATTTGTGT | 9 | 647 |
| 1040111 | 2755 | 2774 | 437474 | 437493 | ACTCTGGATGAAATCTTCTG | 71 | 648 |
| 1040143 | 3244 | 3263 | 457497 | 457516 | GCTGGGTTCTATTTTGGTGA | 46 | 649 |
| 1040175 | 4029 | 4048 | 458282 | 458301 | TTTTATTGTAAAATATGTTG | 90 | 650 |
| 1040207 | 4510 | 4529 | 458763 | 458782 | GATAGTAATATATGCTCATC | 9 | 651 |
| 1040239 | 4767 | 4786 | 459020 | 459039 | TTGGTGGTCATTTATTGTCA | 8 | 652 |
| 1040271 | 5224 | 5243 | 459477 | 459496 | ATCTTGCTCACATATATAAA | 33 | 653 |
| 1040303 | 5589 | 5608 | 459842 | 459861 | CTAGACAGCCAAAATGTGGG | 29 | 654 |
| 1040335 | 6017 | 6036 | 460270 | 460289 | CCAGTCAATTCAATACTCGA | 14 | 655 |
| 1040367 | 6475 | 6494 | 460728 | 460747 | CTCCACATTCACTATTCCGT | 13 | 656 |
| 1040399 | 7152 | 7171 | 461405 | 461424 | TTCTTAAGTTAAACATTCTA | 75 | 657 |
| 1040431 | 7622 | 7641 | 461875 | 461894 | GGAGTAATCCACAAGATGCA | 48 | 658 |
| 1040463 | 8111 | 8130 | 462364 | 462383 | TCCTTTCACATCACCACCGA | 42 | 659 |
| 1040495 | 8375 | 8394 | 462628 | 462647 | ATGTAAAAGAAATCTCAGCT | 42 | 660 |
| 1040527 | 8696 | 8715 | 462949 | 462968 | ACATGACAAATTTCTATATA | 79 | 661 |
| 1040559 | 9109 | 9128 | 463362 | 463381 | GTTTTTACTCCCCCCATTTA | 106 | 662 |
| 1040591 | 9441 | 9460 | 463694 | 463713 | TGCACTTAATTTTAATACAG | 24 | 663 |
| 1040623 | 9885 | 9904 | 464138 | 464157 | GGGCAGTATTCACAGAACTG | 27 | 664 |
| 1040655 | 10254 | 10273 | 464507 | 464526 | TCTTAACTATTATGTATGCA | 18 | 665 |
| 1040687 | 10527 | 10546 | 464780 | 464799 | TCAAATTTTGAATCAAACAT | 88 | 666 |
| 1040719 | N/A | N/A | 17960 | 17979 | TGAGTGCACATTTAATCTTT | 11 | 667 |
| 1040751 | N/A | N/A | 31937 | 31956 | TTGTCATATTTTTATAGCAT | 76 | 668 |
| 1040783 | N/A | N/A | 51100 | 51119 | TGTTCATTCCCTTAGTAACT | 21 | 669 |
| 1040815 | N/A | N/A | 77282 | 77301 | GGCAAGATCTTTTAAAGTCC | 18 | 670 |
| 1040847 | N/A | N/A | 94809 | 94828 | AGACTGTTTCTTTACCACAT | 14 | 671 |
| 1040879 | N/A | N/A | 118132 | 118151 | TCCACCAGTATTTATGGAGT | 119 | 672 |
| 1040911 | N/A | N/A | 151437 | 151456 | CTTTAGTATTTTTATCATTA | 40 | 673 |
| 1040943 | N/A | N/A | 179378 | 179397 | AACAGTACAATTTACTTGAC | 56 | 674 |
| 1040975 | N/A | N/A | 195960 | 195979 | CCTTTAAAAACCAACACAGT | 84 | 675 |
| 1041007 | N/A | N/A | 216607 | 216626 | TCTTGTCATTTTTAACATCC | 28 | 676 |
| 1041039 | N/A | N/A | 237165 | 237184 | ACTCAATTTTAAAGACTCGG | 38 | 677 |
| 1041071 | N/A | N/A | 258705 | 258724 | ATGTGTTGAATTTAACCAGC | 22 | 678 |

TABLE 10-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041103 | N/A | N/A | 276428 | 276447 | CTCATTAATTAAATCATTCG | 105 | 679 |
| 1041135 | N/A | N/A | 295010 | 295029 | CACCTAAAAATACAGGAAGT | 76 | 680 |
| 1041167 | N/A | N/A | 324809 | 324828 | CCAAGAATTTAAAAGGACA | 42 | 681 |
| 1041199 | N/A | N/A | 345760 | 345779 | TGTCTCAAACTATTCCCATT | 26 | 682 |
| 1041231 | N/A | N/A | 371655 | 371674 | TTAACAATCTTTTAGACCTG | 24 | 683 |
| 1041263 | N/A | N/A | 393703 | 393722 | GACATATTTCAAAAATGCAA | 68 | 684 |
| 1041295 | N/A | N/A | 426181 | 426200 | AACTTGTTTCAAAGTGAGAG | 88 | 685 |
| 1041327 | N/A | N/A | 437896 | 437915 | TCAGGGTTCCTCATCTTAAT | 24 | 686 |
| 1041359 | N/A | N/A | 438301 | 438320 | AGAGAGTATAAAAATTATCT | 72 | 687 |
| 1041391 | N/A | N/A | 438910 | 438929 | GCAGCCTCCTATATTGGTCC | 40 | 688 |
| 1041423 | N/A | N/A | 439178 | 439197 | CCAGTGACTCATCTTGGCTA | 48 | 689 |
| 1041455 | N/A | N/A | 439863 | 439882 | TGGTCCTTTCCTCACTTGGG | 27 | 690 |
| 1041487 | N/A | N/A | 440220 | 440239 | CATGTTTATTTTCCATGTGT | 8 | 691 |
| 1041519 | N/A | N/A | 440788 | 440807 | ACACACCTAGATCTTCCTCC | 49 | 692 |
| 1041551 | N/A | N/A | 441387 | 441406 | CAGCAGTGCCTAACCAGTTG | 43 | 693 |
| 1041583 | N/A | N/A | 441652 | 441671 | TGCCAGAGACCCAAATCCGC | 64 | 694 |
| 1041615 | N/A | N/A | 442276 | 442295 | TCATCCCCAAACTAAACACC | 100 | 695 |
| 1041647 | N/A | N/A | 442821 | 442840 | GCTAACCTACTTCCTACCCA | 59 | 696 |
| 1041679 | N/A | N/A | 443177 | 443196 | CATGACATCATTTAGCCTTA | 12 | 697 |
| 1041711 | N/A | N/A | 443557 | 443576 | GGCCCTAATAACACAGAGCC | 113 | 698 |
| 1041743 | N/A | N/A | 444006 | 444025 | GCGGCACAAATCCAGGGCTG | 71 | 699 |
| 1041775 | N/A | N/A | 444407 | 444426 | GTAGTATAAACTATGGACTT | 26 | 700 |
| 1041807 | N/A | N/A | 445306 | 445325 | AGGGTTGTTCAGTAAACCCA | 134 | 701 |
| 1041839 | N/A | N/A | 445658 | 445677 | GCTAGGTTTCAGTAAGTATG | 9 | 702 |
| 1041871 | N/A | N/A | 445920 | 445939 | ACACGCATATTTATGCTGTT | 64 | 703 |
| 1041903 | N/A | N/A | 446128 | 446147 | ACCTCCAACTCCCATTTTGG | 54 | 704 |
| 1041935 | N/A | N/A | 446724 | 446743 | GTAAATATATCCTGTTTCAA | 59 | 705 |
| 1041967 | N/A | N/A | 446975 | 446994 | TCACCTTGTCAGATGCTGAG | 45 | 706 |
| 1041999 | N/A | N/A | 447909 | 447928 | GGTGAGCAACCATTCCAGAC | 74 | 707 |
| 1042031 | N/A | N/A | 448558 | 448577 | CTCGGTCACCACATGCAAGC | 102 | 708 |
| 1042063 | N/A | N/A | 448821 | 448840 | GACCTAAAACACACCAGACC | 78 | 709 |
| 1042095 | N/A | N/A | 449388 | 449407 | ATAGCTTCAAAATATTGTTA | 31 | 710 |
| 1042127 | N/A | N/A | 449700 | 449719 | ATCTTTATTTTATAATTAGG | 87 | 711 |
| 1042159 | N/A | N/A | 449981 | 450000 | GATGCCACGACCAGATATCA | 73 | 712 |
| 1042191 | N/A | N/A | 450575 | 450594 | ACCAAACTCCAAATCTCCAA | 38 | 713 |
| 1042223 | N/A | N/A | 451243 | 451262 | TCACCTTCTTGAACCCTCA | 62 | 714 |
| 1042255 | N/A | N/A | 451690 | 451709 | TCATTATTTCCGCATCTCAA | 13 | 715 |

TABLE 10-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1042287 | N/A | N/A | 451970 | 451989 | CCGGACACCTACCCATGGAG | 82 | 716 |
| 1042319 | N/A | N/A | 452312 | 452331 | CACTGTATTCTAAGTAGGAG | 81 | 717 |
| 1042351 | N/A | N/A | 452637 | 452656 | GCCTCCTGACCTCTACCCTT | 56 | 718 |
| 1042383 | N/A | N/A | 453119 | 453138 | AGTAGATTTCCACAGATTGT | 26 | 719 |
| 1042415 | N/A | N/A | 453901 | 453920 | AGCCTCTAGAACAAAATACA | 97 | 720 |
| 1042447 | N/A | N/A | 455088 | 455107 | AGCTTGAGAATTTTGATAGG | 22 | 721 |
| 1042479 | N/A | N/A | 455365 | 455384 | GAACCACAAGCCAACAGGCC | 89 | 722 |
| 1042511 | N/A | N/A | 456665 | 456684 | ACTGTGAGTTCCAAGAAGCA | 49 | 723 |

TABLE 11

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 3 | 138 |
| 1040080* | 824 | 843 | 435543 | 435562 | TGGGTACAATCCGCCAACAG | 32 | 724 |
| 1040112 | 2813 | 2832 | 437532 | 437551 | TGTCTTCAATCCTCTCTACG | 65 | 725 |
| 1040144 | 3334 | 3353 | 457587 | 457606 | AGGAAGAGTCAAAGGTGGTT | 41 | 726 |
| 1040176 | 4034 | 4053 | 458287 | 458306 | GTTGCTTTTATTGTAAAATA | 29 | 727 |
| 1040208 | 4512 | 4531 | 458765 | 458784 | AAGATAGTAATATATGCTCA | 11 | 728 |
| 1040240 | 4802 | 4821 | 459055 | 459074 | CATCAAAGTGAAAAGTGCCT | 48 | 729 |
| 1040272 | 5278 | 5297 | 459531 | 459550 | CCATTCTGAAAATAACATTA | 15 | 730 |
| 1040304 | 5614 | 5633 | 459867 | 459886 | GGTGAACCCTAAATGTAAAT | 40 | 731 |
| 1040336 | 6018 | 6037 | 460271 | 460290 | TCCAGTCAATTCAATACTCG | 26 | 732 |
| 1040368 | 6478 | 6497 | 460731 | 460750 | ACACTCCACATTCACTATTC | 55 | 733 |
| 1040400 | 7162 | 7181 | 461415 | 461434 | ACTGAAATAATTCTTAAGTT | 108 | 734 |
| 1040432 | 7653 | 7672 | 461906 | 461925 | AGCATTATATTGCAATCTAT | 31 | 735 |
| 1040464 | 8113 | 8132 | 462366 | 462385 | TCTCCTTTCACATCACCACC | 27 | 736 |
| 1040496 | 8385 | 8404 | 462638 | 462657 | GAGGTCATCTATGTAAAAGA | 15 | 737 |
| 1040528 | 8697 | 8716 | 462950 | 462969 | GACATGACAAATTTCTATAT | 12 | 738 |
| 1040560 | 9114 | 9133 | 463367 | 463386 | ATCATGTTTTTACTCCCCCC | 48 | 739 |
| 1040592 | 9454 | 9473 | 463707 | 463726 | CCTATTGGCCAAATGCACTT | 46 | 740 |
| 1040624 | 9970 | 9989 | 464223 | 464242 | TCTTGAAACCTCCTTTCGGC | 74 | 741 |
| 1040656 | 10255 | 10274 | 464508 | 464527 | CTCTTAACTATTATGTATGC | 25 | 742 |
| 1040688 | 10529 | 10548 | 464782 | 464801 | GTTCAAATTTTGAATCAAAC | 39 | 743 |
| 1040720 | N/A | N/A | 18197 | 18216 | CCCAAATTTCAAGGTCCTT | 6 | 744 |

TABLE 11-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040752 | N/A | N/A | 32181 | 32200 | GTGGTCAAAGAATCTGTTTC | 10 | 745 |
| 1040784 | N/A | N/A | 51766 | 51785 | TAGAAACTAATTTATTAGTG | 119 | 746 |
| 1040816 | N/A | N/A | 77793 | 77812 | ACACAGATTATTTATAGTCA | 13 | 747 |
| 1040848 | N/A | N/A | 96129 | 96148 | CACTTTCTAGATTATTCTTA | 84 | 748 |
| 1040880 | N/A | N/A | 118292 | 118311 | ACTCTCTACCTTTAAGATTT | 28 | 749 |
| 1040912 | N/A | N/A | 153619 | 153638 | CATCTATTTATTTACCTTCT | 30 | 750 |
| 1040944 | N/A | N/A | 179493 | 179512 | GAACTTAAAATTCCCTAGGA | 111 | 751 |
| 1040976 | N/A | N/A | 195968 | 195987 | TCTTTTAACCTTTAAAAACC | 53 | 752 |
| 1041008 | N/A | N/A | 216637 | 216656 | ACCTGCTTTCAAAAGTCAAA | 72 | 753 |
| 1041040 | N/A | N/A | 238066 | 238085 | CAAGTAATACAAATCCACAG | 65 | 754 |
| 1041072 | N/A | N/A | 259575 | 259594 | CAGGACTTATTTTATATATG | 32 | 755 |
| 1041104 | N/A | N/A | 276769 | 276788 | CTTCCCAAATACATCATCGA | 101 | 756 |
| 1041136 | N/A | N/A | 295238 | 295257 | CATTTAAAAACTGTACATGG | 20 | 757 |
| 1041168 | N/A | N/A | 324921 | 324940 | ATCTAAATTTAAACTGCACA | 31 | 758 |
| 1041200 | N/A | N/A | 347770 | 347789 | TGGTCAATAATTTATATGGC | 2 | 759 |
| 1041232 | N/A | N/A | 372753 | 372772 | AACTATTATATTTATAGATT | 108 | 760 |
| 1041264 | N/A | N/A | 395038 | 395057 | AGCTGTAAAATATATCCCTG | 8 | 761 |
| 1041296 | N/A | N/A | 427897 | 427916 | AACCTTACTTAAATATCTCA | 62 | 762 |
| 1041328 | N/A | N/A | 437897 | 437916 | ATCAGGGTTCCTCATCTTAA | 11 | 763 |
| 1041360 | N/A | N/A | 438322 | 438341 | GTGCCCTTTCCTCTTGGGAT | 58 | 764 |
| 1041392 | N/A | N/A | 438914 | 438933 | CCCAGCAGCCTCCTATATTG | 91 | 765 |
| 1041424 | N/A | N/A | 439182 | 439201 | ACTTCCAGTGACTCATCTTG | 34 | 766 |
| 1041456 | N/A | N/A | 439866 | 439885 | ATTTGGTCCTTTCCTCACTT | 28 | 767 |
| 1041488 | N/A | N/A | 440222 | 440241 | CTCATGTTTATTTTCCATGT | 31 | 768 |
| 1041520 | N/A | N/A | 440796 | 440815 | AGGGAAAAACACACCTAGAT | 39 | 769 |
| 1041552 | N/A | N/A | 441389 | 441408 | GTCAGCAGTGCCTAACCAGT | 41 | 770 |
| 1041584 | N/A | N/A | 441726 | 441745 | ACAGAAAAACAAAACTCATT | 105 | 771 |
| 1041616 | N/A | N/A | 442285 | 442304 | CCTTAAAAATCATCCCCAAA | 99 | 772 |
| 1041648 | N/A | N/A | 442823 | 442842 | CAGCTAACCTACTTCCTACC | 90 | 773 |
| 1041680 | N/A | N/A | 443212 | 443231 | TCAGAAATACAGATTGATAT | 44 | 774 |
| 1041712 | N/A | N/A | 443559 | 443578 | ACGGCCCTAATAACACAGAG | 94 | 775 |
| 1041744 | N/A | N/A | 444009 | 444028 | ACTGCGGCACAAATCCAGGG | 32 | 776 |
| 1041776 | N/A | N/A | 444408 | 444427 | TGTAGTATAAACTATGGACT | 23 | 777 |
| 1041808 | N/A | N/A | 445316 | 445335 | GAAGTGTTTCAGGGTTGTTC | 8 | 778 |
| 1041840 | N/A | N/A | 445659 | 445678 | AGCTAGGTTTCAGTAAGTAT | 7 | 779 |
| 1041872 | N/A | N/A | 445921 | 445940 | TACACGCATATTTATGCTGT | 98 | 780 |
| 1041904 | N/A | N/A | 446135 | 446154 | AACTGTCACCTCCAACTCCC | 57 | 781 |

TABLE 11-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041936 | N/A | N/A | 446727 | 446746 | CCAGTAAATATATCCTGTTT | 26 | 782 |
| 1041968 | N/A | N/A | 446985 | 447004 | CATAGCCACCTCACCTTGTC | 72 | 783 |
| 1042000 | N/A | N/A | 447963 | 447982 | GCAACAGACCAGTAGCAGTC | 79 | 784 |
| 1042032 | N/A | N/A | 448600 | 448619 | TACCTCCACCACCTTTGTCC | 63 | 785 |
| 1042064 | N/A | N/A | 448823 | 448842 | GTGACCTAAAACACACCAGA | 37 | 786 |
| 1042096 | N/A | N/A | 449389 | 449408 | GATAGCTTCAAAATATTGTT | 20 | 787 |
| 1042128 | N/A | N/A | 449708 | 449727 | GCAAATCTATCTTTATTTTA | 79 | 788 |
| 1042160 | N/A | N/A | 449991 | 450010 | CCTGCGAAAAGATGCCACGA | 117 | 789 |
| 1042192 | N/A | N/A | 450674 | 450693 | AAGTTCAGTTACAGAGGTGC | 19 | 790 |
| 1042224 | N/A | N/A | 451247 | 451266 | GTTCTCAACCTTCTTGAACC | 110 | 791 |
| 1042256 | N/A | N/A | 451693 | 451712 | CTTTCATTATTTCCGCATCT | 14 | 792 |
| 1042288 | N/A | N/A | 451971 | 451990 | GCCGGACACCTACCCATGGA | 132 | 793 |
| 1042320 | N/A | N/A | 452314 | 452333 | CCCACTGTATTCTAAGTAGG | 82 | 794 |
| 1042352 | N/A | N/A | 452646 | 452665 | TTTTTCTGTGCCTCCTGACC | 59 | 795 |
| 1042384 | N/A | N/A | 453143 | 453162 | AAGTACCAAAAAAACTTTAA | 77 | 796 |
| 1042416 | N/A | N/A | 454243 | 454262 | AGCCTCTAGAACAGGCTGGG | 131 | 797 |
| 1042448 | N/A | N/A | 455090 | 455109 | ACAGCTTGAGAATTTTGATA | 21 | 798 |
| 1042480 | N/A | N/A | 455370 | 455389 | ACAGTGAACCACAAGCCAAC | 107 | 799 |
| 1042512 | N/A | N/A | 456692 | 456711 | ACAGGACTAAACATGGATCA | 39 | 800 |

TABLE 12

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 1 | 138 |
| 1040081* | 856 | 875 | 435575 | 435594 | ATCCAGGCTCTTCATGAGGA | 5 | 801 |
| 1040113 | 2819 | 2838 | 437538 | 437557 | TATGGCTGTCTTCAATCCTC | 53 | 802 |
| 1040145 | 3369 | 3388 | 457622 | 457641 | CAAATCTTAACCTCCTGAGG | 48 | 803 |
| 1040177 | 4047 | 4066 | 458300 | 458319 | TATACAATTAAAAGTTGCTT | 110 | 804 |
| 1040209 | 4531 | 4550 | 458784 | 458803 | CAGTATTTTTAAATGCTTAA | 35 | 805 |
| 1040241 | 4815 | 4834 | 459068 | 459087 | ACTGATTCTCAGACATCAAA | 40 | 806 |
| 1040273 | 5279 | 5298 | 459532 | 459551 | GCCATTCTGAAAATAACATT | 9 | 807 |
| 1040305 | 5616 | 5635 | 459869 | 459888 | CTGGTGAACCCTAAATGTAA | 43 | 808 |
| 1040337 | 6019 | 6038 | 460272 | 460291 | ATCCAGTCAATTCAATACTC | 10 | 809 |
| 1040369 | 6480 | 6499 | 460733 | 460752 | CCACACTCCACATTCACTAT | 35 | 810 |

TABLE 12-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040401 | 7190 | 7209 | 461443 | 461462 | CCCCTCTGCCCCAGTGTGGC | 96 | 811 |
| 1040433 | 7656 | 7675 | 461909 | 461928 | TGCAGCATTATATTGCAATC | 74 | 812 |
| 1040465 | 8114 | 8133 | 462367 | 462386 | CTCTCCTTTCACATCACCAC | 30 | 813 |
| 1040497 | 8417 | 8436 | 462670 | 462689 | TCCTATCATCAGTAAGGTAA | 92 | 814 |
| 1040529 | 8711 | 8730 | 462964 | 462983 | AATCTGATCATTTAGACATG | 42 | 815 |
| 1040561 | 9115 | 9134 | 463368 | 463387 | AATCATGTTTTACTCCCCC | 76 | 816 |
| 1040593 | 9464 | 9483 | 463717 | 463736 | ATAGATACTACCTATTGGCC | 39 | 817 |
| 1040625 | 9971 | 9990 | 464224 | 464243 | ATCTTGAAACCTCCTTTCGG | 55 | 818 |
| 1040657 | 10257 | 10276 | 464510 | 464529 | AGCTCTTAACTATTATGTAT | 16 | 819 |
| 1040689 | 10559 | 10578 | 464812 | 464831 | GTATACAGACAATTTATTTA | 83 | 820 |
| 1040721 | N/A | N/A | 18359 | 18378 | ACATGGTATTTTTATCAGTC | 3 | 821 |
| 1040753 | N/A | N/A | 33291 | 33310 | CCTAACAAAATTTCCCTTCA | 73 | 822 |
| 1040785 | N/A | N/A | 53624 | 53643 | GTGAATTTTCCTTAAATTTC | 23 | 823 |
| 1040817 | N/A | N/A | 77899 | 77918 | TGCAAATTCTAAAAATTACT | 101 | 824 |
| 1040849 | N/A | N/A | 96635 | 96654 | TTCTTGTTTCAAAGTGAGGA | 121 | 825 |
| 1040881 | N/A | N/A | 118343 | 118362 | GACCTCATCCATTATAATAT | 52 | 826 |
| 1040913 | N/A | N/A | 153709 | 153728 | CCAACCAACCAAAAACTCAC | 101 | 827 |
| 1040945 | N/A | N/A | 179793 | 179812 | CATAGTTATATTTAATCATG | 64 | 828 |
| 1040977 | N/A | N/A | 196970 | 196989 | ATGCCTCACCTTTAAATAGT | 82 | 829 |
| 1041009 | N/A | N/A | 217125 | 217144 | GACAAGTTTATTTATTTTTC | 25 | 830 |
| 1041041 | N/A | N/A | 239500 | 239519 | AACTGATTTCAAAGTCAGAC | 131 | 831 |
| 1041073 | N/A | N/A | 260025 | 260044 | ACTGAAACTTTTTAACATAC | 37 | 832 |
| 1041105 | N/A | N/A | 278198 | 278217 | CAGCAAATACAAACAGGACC | 3 | 833 |
| 1041137 | N/A | N/A | 295336 | 295355 | ACACAGTTACAAATCAATGC | 1 | 834 |
| 1041169 | N/A | N/A | 324924 | 324943 | TGGATCTAAATTTAAACTGC | 6 | 835 |
| 1041201 | N/A | N/A | 348183 | 348202 | ATGCTCAAACCTCATTCATT | 23 | 836 |
| 1041233 | N/A | N/A | 373954 | 373973 | TACTCCTTATTTTAAATATA | 114 | 837 |
| 1041265 | N/A | N/A | 395428 | 395447 | AAGGTTCTATTTTATATGCC | 24 | 838 |
| 1041297 | N/A | N/A | 428019 | 428038 | AGTGTTAGAGAATACTTTTC | 33 | 839 |
| 1041329 | N/A | N/A | 437898 | 437917 | AATCAGGGTTCCTCATCTTA | 26 | 840 |
| 1041361 | N/A | N/A | 438362 | 438381 | TGCCCCCCACTTTACGGTGT | 98 | 841 |
| 1041393 | N/A | N/A | 438931 | 438950 | CAGTCCAGAGCCCACTCCCC | 96 | 842 |
| 1041425 | N/A | N/A | 439188 | 439207 | AACCATACTTCCAGTGACTC | 10 | 843 |
| 1041457 | N/A | N/A | 439897 | 439916 | CCAGTCATTCACGAGTGGTT | 60 | 844 |
| 1041489 | N/A | N/A | 440232 | 440251 | TGACTCTTCACTCATGTTTA | 67 | 845 |
| 1041521 | N/A | N/A | 440798 | 440817 | GTAGGGAAAAACACACCTAG | 87 | 846 |
| 1041553 | N/A | N/A | 441417 | 441436 | CATTTCTGAATTTCTCTGTG | 15 | 847 |

TABLE 12-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041585 | N/A | N/A | 441728 | 441747 | CCACAGAAAAACAAAACTCA | 100 | 848 |
| 1041617 | N/A | N/A | 442286 | 442305 | CCCTTAAAAATCATCCCCAA | 103 | 849 |
| 1041649 | N/A | N/A | 442824 | 442843 | GCAGCTAACCTACTTCCTAC | 24 | 850 |
| 1041681 | N/A | N/A | 443215 | 443234 | TACTCAGAAATACAGATTGA | 62 | 851 |
| 1041713 | N/A | N/A | 443563 | 443582 | ACAGACGGCCCTAATAACAC | 106 | 852 |
| 1041745 | N/A | N/A | 444022 | 444041 | TGTATTACCAACAACTGCGG | 37 | 853 |
| 1041777 | N/A | N/A | 444419 | 444438 | ACAGAGTGAACTGTAGTATA | 3 | 854 |
| 1041809 | N/A | N/A | 445337 | 445356 | AGCCTGACTCAGTCCTTGGT | 122 | 855 |
| 1041841 | N/A | N/A | 445672 | 445691 | GAATTCTCTCATAAGCTAGG | 51 | 856 |
| 1041873 | N/A | N/A | 445928 | 445947 | ATGCACATACACGCATATTT | 57 | 857 |
| 1041905 | N/A | N/A | 446161 | 446180 | CCATCCCCCTAAATCGACTC | 84 | 858 |
| 1041937 | N/A | N/A | 446729 | 446748 | ATCCAGTAAATATATCCTGT | 15 | 859 |
| 1041969 | N/A | N/A | 447005 | 447024 | GGCAGCTTTCTCAGCGGAGC | 65 | 860 |
| 1042001 | N/A | N/A | 447978 | 447997 | ATCCCCAACCCCCAGGCAAC | 110 | 861 |
| 1042033 | N/A | N/A | 448602 | 448621 | ACTACCTCCACCACCTTTGT | 57 | 862 |
| 1042065 | N/A | N/A | 448825 | 448844 | AAGTGACCTAAAACACACCA | 88 | 863 |
| 1042097 | N/A | N/A | 449390 | 449409 | TGATAGCTTCAAAATATTGT | 30 | 864 |
| 1042129 | N/A | N/A | 449710 | 449729 | TAGCAAATCTATCTTTATTT | 70 | 865 |
| 1042161 | N/A | N/A | 450005 | 450024 | AGGAGCTGTGTCACCCTGCG | 71 | 866 |
| 1042193 | N/A | N/A | 450685 | 450704 | CAGCCAAACCTAAGTTCAGT | 32 | 867 |
| 1042225 | N/A | N/A | 451248 | 451267 | AGTTCTCAACCTTCTTGAAC | 78 | 868 |
| 1042257 | N/A | N/A | 451698 | 451717 | AAAGCCTTTCATTATTTCCG | 9 | 869 |
| 1042289 | N/A | N/A | 452004 | 452023 | CCGGATAACTCCCTGTCTCC | 80 | 870 |
| 1042321 | N/A | N/A | 452315 | 452334 | ACCCACTGTATTCTAAGTAG | 23 | 871 |
| 1042353 | N/A | N/A | 452658 | 452677 | AACCCATTTTCTTTTTTCTG | 119 | 872 |
| 1042385 | N/A | N/A | 453188 | 453207 | GATTTATACACATTCAGAC | 58 | 873 |
| 1042417 | N/A | N/A | 454279 | 454298 | CATCTTGTAAACTAAACAGG | 58 | 874 |
| 1042449 | N/A | N/A | 455116 | 455135 | GCTTACAATAATTAAGAAGA | 60 | 875 |
| 1042481 | N/A | N/A | 455372 | 455391 | AGACAGTGAACCACAAGCCA | 95 | 876 |
| 1042513 | N/A | N/A | 456694 | 456713 | GGACAGGACTAAACATGGAT | 23 | 877 |

TABLE 13

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 2 | 138 |
| 1040082 | 896 | 915 | 435615 | 435634 | AGTCTGATAAACGGAAAGTC | 58 | 878 |
| 1040114 | 2839 | 2858 | 437558 | 437577 | TATCACGGCCACGCCCGGGC | 149 | 879 |
| 1040146 | 3372 | 3391 | 457625 | 457644 | ATGCAAATCTTAACCTCCTG | 12 | 880 |
| 1040178 | 4048 | 4067 | 458301 | 458320 | CTATACAATTAAAAGTTGCT | 111 | 881 |
| 1040210 | 4532 | 4551 | 458785 | 458804 | ACAGTATTTTAAATGCTTA | 52 | 882 |
| 1040242 | 4816 | 4835 | 459069 | 459088 | AACTGATTCTCAGACATCAA | 39 | 883 |
| 1040274 | 5306 | 5325 | 459559 | 459578 | GATTTGATTTTGAATAGAAA | 64 | 884 |
| 1040306 | 5617 | 5636 | 459870 | 459889 | CCTGGTGAACCCTAAATGTA | 66 | 885 |
| 1040338 | 6025 | 6044 | 460278 | 460297 | TAGTGGATCCAGTCAATTCA | 22 | 886 |
| 1040370 | 6483 | 6502 | 460736 | 460755 | TCTCCACACTCCACATTCAC | 87 | 887 |
| 1040402 | 7241 | 7260 | 461494 | 461513 | CACTTTAAAGATCTGAGGT | 51 | 888 |
| 1040434 | 7676 | 7695 | 461929 | 461948 | GCTACTGTTCATCTTGAACA | 76 | 889 |
| 1040466 | 8123 | 8142 | 462376 | 462395 | AGTGTAATTCTCTCCTTTCA | 17 | 890 |
| 1040498 | 8426 | 8445 | 462679 | 462698 | AAGAAAAGATCCTATCATCA | 76 | 891 |
| 1040530 | 8716 | 8735 | 462969 | 462988 | ATACAAATCTGATCATTTAG | 60 | 892 |
| 1040562 | 9116 | 9135 | 463369 | 463388 | AAATCATGTTTTTACTCCCC | 81 | 893 |
| 1040594 | 9466 | 9485 | 463719 | 463738 | GTATAGATACTACCTATTGG | 27 | 894 |
| 1040626 | 9991 | 10010 | 464244 | 464263 | CCACAAATACTGACAGGACT | 18 | 895 |
| 1040658 | 10258 | 10277 | 464511 | 464530 | AAGCTCTTAACTATTATGTA | 28 | 896 |
| 1040690 | 10561 | 10580 | 464814 | 464833 | TGGTATACAGACAATTTATT | 58 | 897 |
| 1040722 | N/A | N/A | 18895 | 18914 | AACTTTAAAACCAAAGAGCC | 89 | 898 |
| 1040754 | N/A | N/A | 33435 | 33454 | TGTACAATAATATATTTCTT | 63 | 899 |
| 1040786 | N/A | N/A | 53693 | 53712 | GCAGAAATTCATTAAAAAGG | 44 | 900 |
| 1040818 | N/A | N/A | 78103 | 78122 | TACTGGTATATTTATTTGTT | 25 | 901 |
| 1040850 | N/A | N/A | 96906 | 96925 | CTTGAGTTTCATTATCTCCT | 62 | 902 |
| 1040882 | N/A | N/A | 122955 | 122974 | CATACATTCCCTTAAGCCAA | 45 | 903 |
| 1040914 | N/A | N/A | 154008 | 154027 | AGTATTATTTAAAACTACAT | 107 | 904 |
| 1040946 | N/A | N/A | 180271 | 180290 | CCATGGTTTCAAAGCTCTGT | 68 | 905 |
| 1040978 | N/A | N/A | 198120 | 198139 | AGCTATAAAATATAAACTTC | 116 | 906 |
| 1041010 | N/A | N/A | 218069 | 218088 | AGCTTTTGAATTTATTATGA | 63 | 907 |
| 1041042 | N/A | N/A | 240054 | 240073 | CAGAGACTATTTAAAGACG | 67 | 908 |
| 1041074 | N/A | N/A | 262925 | 262944 | CTCTTATTTTAAACTGGTGC | 17 | 909 |
| 1041106 | N/A | N/A | 279276 | 279295 | TTACTGATTATTTAACCCTG | 1 | 910 |
| 1041138 | N/A | N/A | 296194 | 296213 | AGTTCATTTTAAACTGTATT | 1 | 911 |
| 1041170 | N/A | N/A | 326365 | 326384 | TGTATTATTTTCTAACAGAA | 17 | 912 |
| 1041202 | N/A | N/A | 349100 | 349119 | AAGTATACAATTTAAGGATC | 18 | 913 |

TABLE 13-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041234 | N/A | N/A | 374001 | 374020 | ATTAGATTTCCTTACTGCAA | 16 | 914 |
| 1041266 | N/A | N/A | 395704 | 395723 | CCTCTCAAAACCACTTTTAT | 123 | 915 |
| 1041298 | N/A | N/A | 428253 | 428272 | CCCTCAATTCAAAGACAAAT | 128 | 916 |
| 1041330 | N/A | N/A | 437904 | 437923 | TTTCCTAATCAGGGTTCCTC | 24 | 917 |
| 1041362 | N/A | N/A | 438363 | 438382 | GTGCCCCCACTTTACGGTG | 35 | 918 |
| 1041394 | N/A | N/A | 438955 | 438974 | CCTGACTTTCATATGCAAAC | 23 | 919 |
| 1041426 | N/A | N/A | 439190 | 439209 | TTAACCATACTTCCAGTGAC | 49 | 920 |
| 1041458 | N/A | N/A | 439905 | 439924 | CCCCATATCCAGTCATTCAC | 91 | 921 |
| 1041490 | N/A | N/A | 440236 | 440255 | GCAATGACTCTTCACTCATG | 49 | 922 |
| 1041522 | N/A | N/A | 440800 | 440819 | GAGTAGGGAAAAACACACCT | 49 | 923 |
| 1041554 | N/A | N/A | 441434 | 441453 | AAGCTCAACAATTTGCACAT | 37 | 924 |
| 1041586 | N/A | N/A | 441742 | 441761 | ACGAACACAAAAACCCACAG | 65 | 925 |
| 1041618 | N/A | N/A | 442287 | 442306 | CCCCTTAAAAATCATCCCCA | 84 | 926 |
| 1041650 | N/A | N/A | 442825 | 442844 | AGCAGCTAACCTACTTCCTA | 34 | 927 |
| 1041682 | N/A | N/A | 443218 | 443237 | TCATACTCAGAAATACAGAT | 19 | 928 |
| 1041714 | N/A | N/A | 443616 | 443635 | TTAAGCAGCCACCGAGTCAG | 94 | 929 |
| 1041746 | N/A | N/A | 444023 | 444042 | GTGTATTACCAACAACTGCG | 8 | 930 |
| 1041778 | N/A | N/A | 444443 | 444462 | TTCATCAAAAACAGCATGTA | 85 | 931 |
| 1041810 | N/A | N/A | 445344 | 445363 | CACGCAAAGCCTGACTCAGT | 50 | 932 |
| 1041842 | N/A | N/A | 445673 | 445692 | TGAATTCTCTCATAAGCTAG | 96 | 933 |
| 1041874 | N/A | N/A | 445931 | 445950 | ACTATGCACATACACGCATA | 108 | 934 |
| 1041906 | N/A | N/A | 446163 | 446182 | ATCCATCCCCCTAAATCGAC | 54 | 935 |
| 1041938 | N/A | N/A | 446730 | 446749 | CATCCAGTAAATATATCCTG | 17 | 936 |
| 1041970 | N/A | N/A | 447020 | 447039 | CTTTACCGCCTAACAGGCAG | 123 | 937 |
| 1042002 | N/A | N/A | 447979 | 447998 | GATCCCCAACCCCCAGGCAA | 94 | 938 |
| 1042034 | N/A | N/A | 448606 | 448625 | TTTTACTACCTCCACCACCT | 61 | 939 |
| 1042066 | N/A | N/A | 448836 | 448855 | ACTCAAACTTAAAGTGACCT | 66 | 940 |
| 1042098 | N/A | N/A | 449409 | 449428 | TGGGTATTCTCTATGATGCT | 26 | 941 |
| 1042130 | N/A | N/A | 449713 | 449732 | TCATAGCAAATCTATCTTTA | 74 | 942 |
| 1042162 | N/A | N/A | 450017 | 450036 | GCTTCCTACCAAAGGAGCTG | 128 | 943 |
| 1042194 | N/A | N/A | 450686 | 450705 | GCAGCCAAACCTAAGTTCAG | 78 | 944 |
| 1042226 | N/A | N/A | 451252 | 451271 | AAGAAGTTCTCAACCTTCTT | 91 | 945 |
| 1042258 | N/A | N/A | 451699 | 451718 | GAAAGCCTTTCATTATTTCC | 29 | 946 |
| 1042290 | N/A | N/A | 452046 | 452065 | TAGTTCCAAACATGTCAGCC | 29 | 947 |
| 1042322 | N/A | N/A | 452353 | 452372 | GACAAATATACTTACAAGTG | 17 | 948 |
| 1042354 | N/A | N/A | 452664 | 452683 | CCCCCAAACCCATTTTCTTT | 121 | 949 |

TABLE 13-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1042386 | N/A | N/A | 453191 | 453210 | TTGGATTTTATACACATTCA | 45 | 950 |
| 1042418 | N/A | N/A | 454294 | 454313 | GCTATAAATCAAAGACATCT | 61 | 951 |
| 1042450 | N/A | N/A | 455117 | 455136 | TGCTTACAATAATTAAGAAG | 75 | 952 |
| 1042482 | N/A | N/A | 455402 | 455421 | TTGTGACCCCAAAGCACTGT | 100 | 953 |
| 1042514 | N/A | N/A | 456708 | 456727 | GCTATTATCATACAGGACAG | 20 | 954 |

TABLE 14

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 3 | 138 |
| 1040083 | 902 | 921 | 435621 | 435640 | GATTTTAGTCTGATAAACGG | 32 | 955 |
| 1040115 | 2852 | 2871 | 437571 | 437590 | CGACGGCGAACTGTATCACG | 120 | 956 |
| 1040147 | 3386 | 3405 | 457639 | 457658 | TAGACCGGCCTTCAATGCAA | 41 | 957 |
| 1040179 | 4050 | 4069 | 458303 | 458322 | ATCTATACAATTAAAAGTTG | 116 | 958 |
| 1040211 | 4534 | 4553 | 458787 | 458806 | GAACAGTATTTTTAAATGCT | 13 | 959 |
| 1040243 | 4817 | 4836 | 459070 | 459089 | GAACTGATTCTCAGACATCA | 15 | 960 |
| 1040275 | 5323 | 5342 | 459576 | 459595 | ACCAAACATTAAATCTCGAT | 36 | 961 |
| 1040307 | 5636 | 5655 | 459889 | 459908 | GTTTATAAAAATCATTAGTC | 76 | 962 |
| 1040339 | 6064 | 6083 | 460317 | 460336 | GCTCCAAACCATGTGTGTTT | 23 | 963 |
| 1040371 | 6493 | 6512 | 460746 | 460765 | GCCTCCTTCCTCTCCACACT | 54 | 964 |
| 1040403 | 7244 | 7263 | 461497 | 461516 | TTCCACTTTAAAAGATCTGA | 34 | 965 |
| 1040435 | 7696 | 7715 | 461949 | 461968 | GGATTTTATGATTACTAGGA | 9 | 966 |
| 1040467 | 8151 | 8170 | 462404 | 462423 | GGCCTCCACGCCACTTAAAA | 144 | 967 |
| 1040499 | 8432 | 8451 | 462685 | 462704 | TGCTACAAGAAAAGATCCTA | 63 | 968 |
| 1040531 | 8722 | 8741 | 462975 | 462994 | ATAACCATACAAATCTGATC | 61 | 969 |
| 1040563 | 9124 | 9143 | 463377 | 463396 | TTACATTGAAATCATGTTTT | 48 | 970 |
| 1040595 | 9467 | 9486 | 463720 | 463739 | TGTATAGATACTACCTATTG | 53 | 971 |
| 1040627 | 9996 | 10015 | 464249 | 464268 | GGTCACCACAAATACTGACA | 29 | 972 |
| 1040659 | 10269 | 10288 | 464522 | 464541 | TGTCACAATAAAAGCTCTTA | 47 | 973 |
| 1040691 | 10563 | 10582 | 464816 | 464835 | ACTGGTATACAGACAATTTA | 80 | 974 |
| 1040723 | N/A | N/A | 19256 | 19275 | CCCAGCAAAGCCATCCAGTG | 80 | 975 |
| 1040755 | N/A | N/A | 33606 | 33625 | TTGATTACAATTTAAATTCA | 90 | 976 |
| 1040787 | N/A | N/A | 54456 | 54475 | AAGGGAATATTTTACTTTAT | 13 | 977 |
| 1040819 | N/A | N/A | 78391 | 78410 | CTATTATTATTTTACTGGCA | 7 | 978 |
| 1040851 | N/A | N/A | 97882 | 97901 | TTTTATAGCCACTAACCAAC | 96 | 979 |

TABLE 14-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040883 | N/A | N/A | 125349 | 125368 | AACATATTTCATTATAATTC | 100 | 980 |
| 1040915 | N/A | N/A | 154957 | 154976 | ACCCAGCATTTTTAACATTA | 63 | 981 |
| 1040947 | N/A | N/A | 180483 | 180502 | CTTTCATTTATTTAGTGAAA | 116 | 982 |
| 1040979 | N/A | N/A | 200076 | 200095 | TTCCTTACTTTTTAGGATAC | 119 | 983 |
| 1041011 | N/A | N/A | 218138 | 218157 | GATTTATTTTAAAGTACTCT | 83 | 984 |
| 1041043 | N/A | N/A | 241942 | 241961 | GATTCCAAAACCAGACTTGT | 143 | 985 |
| 1041075 | N/A | N/A | 263175 | 263194 | CCATATATAGATTACAAAGC | 39 | 986 |
| 1041107 | N/A | N/A | 281181 | 281200 | TCTTTTAACCCTAAGACTGT | 67 | 987 |
| 1041139 | N/A | N/A | 296440 | 296459 | TGACAGTATTTTTAAAGACT | 2 | 988 |
| 1041171 | N/A | N/A | 326617 | 326636 | ACTGGCAAACCCAAAAGCTA | 103 | 989 |
| 1041203 | N/A | N/A | 349644 | 349663 | ACTGTTAAAACCCATCCAAC | 63 | 990 |
| 1041235 | N/A | N/A | 374559 | 374578 | ATGCAGTTCTAAAAGAAAGC | 66 | 991 |
| 1041267 | N/A | N/A | 397171 | 397190 | AGGCCCAAACCTCTAATCAA | 123 | 992 |
| 1041299 | N/A | N/A | 429792 | 429811 | AAGATTCAAATATATCTTAA | 130 | 993 |
| 1041331 | N/A | N/A | 437924 | 437943 | GGACCTGAAGTCCAGCAGCG | 60 | 994 |
| 1041363 | N/A | N/A | 438401 | 438420 | ACTCCCTCCACCTCCTGACC | 101 | 995 |
| 1041395 | N/A | N/A | 438956 | 438975 | GCCTGACTTTCATATGCAAA | 45 | 996 |
| 1041427 | N/A | N/A | 439210 | 439229 | GCCTGTGGAAATTAAGAGCG | 101 | 997 |
| 1041459 | N/A | N/A | 439912 | 439931 | TGCAAGCCCCCATATCCAGT | 45 | 998 |
| 1041491 | N/A | N/A | 440261 | 440280 | TTAAGGATTCTAAGTACCAT | 20 | 999 |
| 1041523 | N/A | N/A | 440821 | 440840 | TCATTAATTTTGCAAAGTTT | 19 | 1000 |
| 1041555 | N/A | N/A | 441445 | 441464 | TTTTGCTTATTAAGCTCAAC | 49 | 1001 |
| 1041587 | N/A | N/A | 441743 | 441762 | AACGAACACAAAAACCCACA | 105 | 1002 |
| 1041619 | N/A | N/A | 442289 | 442308 | AGCCCCTTAAAAATCATCCC | 116 | 1003 |
| 1041651 | N/A | N/A | 442826 | 442845 | AAGCAGCTAACCTACTTCCT | 53 | 1004 |
| 1041683 | N/A | N/A | 443220 | 443239 | GTTCATACTCAGAAATACAG | 33 | 1005 |
| 1041715 | N/A | N/A | 443625 | 443644 | CACTGAATATTAAGCAGCCA | 76 | 1006 |
| 1041747 | N/A | N/A | 444024 | 444043 | TGTGTATTACCAACAACTGC | 69 | 1007 |
| 1041779 | N/A | N/A | 444458 | 444477 | ACATGACATCATAAATTCAT | 38 | 1008 |
| 1041811 | N/A | N/A | 445353 | 445372 | AATCATGTTCACGCAAAGCC | 41 | 1009 |
| 1041843 | N/A | N/A | 445675 | 445694 | AATGAATTCTCTCATAAGCT | 69 | 1010 |
| 1041875 | N/A | N/A | 445943 | 445962 | CTATATCTAAACACTATGCA | 79 | 1011 |
| 1041907 | N/A | N/A | 446164 | 446183 | CATCCATCCCCCTAAATCGA | 100 | 1012 |
| 1041939 | N/A | N/A | 446731 | 446750 | TCATCCAGTAAATATATCCT | 21 | 1013 |
| 1041971 | N/A | N/A | 447021 | 447040 | GCTTTACCGCCTAACAGGCA | 92 | 1014 |
| 1042003 | N/A | N/A | 447994 | 448013 | CCTCTTTATACCAGGGATCC | 83 | 1015 |

TABLE 14-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1042035 | N/A | N/A | 448607 | 448626 | TTTTTACTACCTCCACCACC | 93 | 1016 |
| 1042067 | N/A | N/A | 448839 | 448858 | GCAACTCAAACTTAAAGTGA | 46 | 1017 |
| 1042099 | N/A | N/A | 449410 | 449429 | ATGGGTATTCTCTATGATGC | 22 | 1018 |
| 1042131 | N/A | N/A | 449715 | 449734 | ATTCATAGCAAATCTATCTT | 102 | 1019 |
| 1042163 | N/A | N/A | 450018 | 450037 | TGCTTCCTACCAAAGGAGCT | 129 | 1020 |
| 1042195 | N/A | N/A | 450687 | 450706 | AGCAGCCAAACCTAAGTTCA | 61 | 1021 |
| 1042227 | N/A | N/A | 451307 | 451326 | ACCCTCTATTAAAAATACTA | 113 | 1022 |
| 1042259 | N/A | N/A | 451702 | 451721 | TTTGAAAGCCTTTCATTATT | 85 | 1023 |
| 1042291 | N/A | N/A | 452049 | 452068 | CCTTAGTTCCAAACATGTCA | 42 | 1024 |
| 1042323 | N/A | N/A | 452358 | 452377 | ACATAGACAAATATACTTAC | 31 | 1025 |
| 1042355 | N/A | N/A | 452665 | 452684 | GCCCCCAAACCCATTTTCTT | 113 | 1026 |
| 1042387 | N/A | N/A | 453354 | 453373 | ATGCACCACCACCACCACGC | 79 | 1027 |
| 1042419 | N/A | N/A | 454295 | 454314 | TGCTATAAATCAAAGACATC | 93 | 1028 |
| 1042451 | N/A | N/A | 455129 | 455148 | TTACAAAGACTATGCTTACA | 68 | 1029 |
| 1042483 | N/A | N/A | 455404 | 455423 | AGTTGTGACCCCAAAGCACT | 94 | 1030 |
| 1042515 | N/A | N/A | 456709 | 456728 | TGCTATTATCATACAGGACA | 21 | 1031 |

TABLE 15

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 2 | 138 |
| 1040084 | 909 | 928 | 435628 | 435647 | TGGCTCTGATTTTAGTCTGA | 34 | 1032 |
| 1040116 | 2895 | 2914 | 457148 | 457167 | TACTCTACCAAAACTTCAAC | 75 | 1033 |
| 1040148 | 3387 | 3406 | 457640 | 457659 | TTAGACCGGCCTTCAATGCA | 39 | 1034 |
| 1040180 | 4134 | 4153 | 458387 | 458406 | GCAGAAATGAAATCCCGCAT | 31 | 1035 |
| 1040212 | 4586 | 4605 | 458839 | 458858 | TGAGATACAGTACTTGTTGA | 12 | 1036 |
| 1040244 | 4866 | 4885 | 459119 | 459138 | TTCTCCATCCCTTTTCTCTC | 25 | 1037 |
| 1040276 | 5325 | 5344 | 459578 | 459597 | GTACCAAACATTAAATCTCG | 43 | 1038 |
| 1040308 | 5638 | 5657 | 459891 | 459910 | CGGTTTATAAAAATCATTAG | 80 | 1039 |
| 1040340 | 6065 | 6084 | 460318 | 460337 | TGCTCCAAACCATGTGTGTT | 42 | 1040 |
| 1040372 | 6500 | 6519 | 460753 | 460772 | TGAATCTGCCTCCTTCCTCT | 29 | 1041 |
| 1040404 | 7245 | 7264 | 461498 | 461517 | TTTCCACTTTAAAAGATCTG | 51 | 1042 |
| 1040436 | 7699 | 7718 | 461952 | 461971 | AGTGGATTTTATGATTACTA | 9 | 1043 |
| 1040468 | 8176 | 8195 | 462429 | 462448 | GGTTAAAAACAAATGTGGAA | 132 | 1044 |
| 1040500 | 8481 | 8500 | 462734 | 462753 | GCTTCTCAAATCAGGTGTAC | 11 | 1045 |

TABLE 15-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040532 | 8726 | 8745 | 462979 | 462998 | GGCCATAACCATACAAATCT | 74 | 1046 |
| 1040564 | 9177 | 9196 | 463430 | 463449 | GGCCTCTTTATATTAAATAA | 135 | 1047 |
| 1040596 | 9510 | 9529 | 463763 | 463782 | TCAGATAAGAAAAGTTATGG | 54 | 1048 |
| 1040628 | 9997 | 10016 | 464250 | 464269 | AGGTCACCACAAATACTGAC | 36 | 1049 |
| 1040660 | 10275 | 10294 | 464528 | 464547 | TTCTCCTGTCACAATAAAAG | 93 | 1050 |
| 1040692 | 10565 | 10584 | 464818 | 464837 | GTACTGGTATACAGACAATT | 95 | 1051 |
| 1040724 | N/A | N/A | 20058 | 20077 | GTCCTCAAAACCTATGGAGC | 127 | 1052 |
| 1040756 | N/A | N/A | 34396 | 34415 | TGGCTTAACCAGGGAGATGT | 13 | 1053 |
| 1040788 | N/A | N/A | 56211 | 56230 | ACTGATAATTTTTAGACATA | 41 | 1054 |
| 1040820 | N/A | N/A | 79273 | 79292 | ACCTCAATCATTTACTCTCT | 22 | 1055 |
| 1040852 | N/A | N/A | 99200 | 99219 | ACTCCTAAAATTTATTGAGG | 124 | 1056 |
| 1040884 | N/A | N/A | 127408 | 127427 | CCCTGAATAGTCTATGCCAT | 37 | 1057 |
| 1040916 | N/A | N/A | 155491 | 155510 | TTCCTTAAAATATGTTGGCA | 43 | 1058 |
| 1040948 | N/A | N/A | 181346 | 181365 | GGAAACAACCAAAAACTGCT | 32 | 1059 |
| 1040980 | N/A | N/A | 202475 | 202494 | TGACACAATATTTACTGTGT | 99 | 1060 |
| 1041012 | N/A | N/A | 218314 | 218333 | TCTCAGTTTCAAAATAGGAC | 32 | 1061 |
| 1041044 | N/A | N/A | 241960 | 241979 | CCTCAAAAAGAATCTGCAGA | 102 | 1062 |
| 1041076 | N/A | N/A | 263468 | 263487 | TCGGTTACTATTTACCTTTC | 60 | 1063 |
| 1041108 | N/A | N/A | 281316 | 281335 | GGACCCTAAATTTAAACAGC | 2 | 1064 |
| 1041140 | N/A | N/A | 296918 | 296937 | TGGAAATTTCAAAAAGCTAA | 32 | 1065 |
| 1041172 | N/A | N/A | 327619 | 327638 | AACAACAAATAATTACCTAT | 114 | 1066 |
| 1041204 | N/A | N/A | 350026 | 350045 | AAGGAAAATCAAACATTGCT | 7 | 1067 |
| 1041236 | N/A | N/A | 375439 | 375458 | AGGTCTAGTATTTATCTTCT | 1 | 1068 |
| 1041268 | N/A | N/A | 398360 | 398379 | GAAACATTATTTTACTTTTC | 65 | 1069 |
| 1041300 | N/A | N/A | 430468 | 430487 | TCCTAAAAATACATCTTAAA | 102 | 1070 |
| 1041332 | N/A | N/A | 437957 | 437976 | CTGGTAAGAAAAAGTGCCGA | 120 | 1071 |
| 1041364 | N/A | N/A | 438416 | 438435 | GCCACATTTCCCCTCACTCC | 23 | 1072 |
| 1041396 | N/A | N/A | 438957 | 438976 | AGCCTGACTTTCATATGCAA | 56 | 1073 |
| 1041428 | N/A | N/A | 439250 | 439269 | GTAATCGATCTAAGAACCTG | 21 | 1074 |
| 1041460 | N/A | N/A | 439916 | 439935 | TTTGTGCAAGCCCCCATATC | 103 | 1075 |
| 1041492 | N/A | N/A | 440277 | 440296 | TGTTCACAAAAATGTGTTAA | 71 | 1076 |
| 1041524 | N/A | N/A | 440828 | 440847 | CATTTAATCATTAATTTTGC | 63 | 1077 |
| 1041556 | N/A | N/A | 441446 | 441465 | ATTTTGCTTATTAAGCTCAA | 38 | 1078 |
| 1041588 | N/A | N/A | 441811 | 441830 | CCAATGATCCCATCACTGCA | 103 | 1079 |
| 1041620 | N/A | N/A | 442290 | 442309 | CAGCCCCTTAAAAATCATCC | 105 | 1080 |
| 1041652 | N/A | N/A | 442846 | 442865 | TGCCAGTTCCTGCATTTTCC | 8 | 1081 |

TABLE 15-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041684 | N/A | N/A | 443222 | 443241 | CAGTTCATACTCAGAAATAC | 50 | 1082 |
| 1041716 | N/A | N/A | 443626 | 443645 | GCACTGAATATTAAGCAGCC | 93 | 1083 |
| 1041748 | N/A | N/A | 444025 | 444044 | GTGTGTATTACCAACAACTG | 16 | 1084 |
| 1041780 | N/A | N/A | 444459 | 444478 | TACATGACATCATAAATTCA | 56 | 1085 |
| 1041812 | N/A | N/A | 445359 | 445378 | ACACTGAATCATGTTCACGC | 7 | 1086 |
| 1041844 | N/A | N/A | 445679 | 445698 | GAGCAATGAATTCTCTCATA | 27 | 1087 |
| 1041876 | N/A | N/A | 445945 | 445964 | TACTATATCTAAACACTATG | 115 | 1088 |
| 1041908 | N/A | N/A | 446169 | 446188 | TCCTCCATCCATCCCCCTAA | 75 | 1089 |
| 1041940 | N/A | N/A | 446740 | 446759 | CCCATTTTTTCATCCAGTAA | 12 | 1090 |
| 1041972 | N/A | N/A | 447022 | 447041 | GGCTTTACCGCCTAACAGGC | 107 | 1091 |
| 1042004 | N/A | N/A | 447996 | 448015 | CTCCTCTTTATACCAGGGAT | 85 | 1092 |
| 1042036 | N/A | N/A | 448608 | 448627 | TTTTTTACTACCTCCACCAC | 105 | 1093 |
| 1042068 | N/A | N/A | 448842 | 448861 | TGGGCAACTCAAACTTAAAG | 57 | 1094 |
| 1042100 | N/A | N/A | 449424 | 449443 | AATTTAAAACCCATATGGGT | 115 | 1095 |
| 1042132 | N/A | N/A | 449743 | 449762 | CACACATCTCAAATAGGTAC | 54 | 1096 |
| 1042164 | N/A | N/A | 450034 | 450053 | GCCTAAATTCTGCCTTTGCT | 35 | 1097 |
| 1042196 | N/A | N/A | 450690 | 450709 | GTGAGCAGCCAAACCTAAGT | 45 | 1098 |
| 1042228 | N/A | N/A | 451308 | 451327 | AACCCTCTATTAAAAATACT | 111 | 1099 |
| 1042260 | N/A | N/A | 451730 | 451749 | CTAAAGACTTCATAATGTTA | 58 | 1100 |
| 1042292 | N/A | N/A | 452051 | 452070 | AGCCTTAGTTCCAAACATGT | 107 | 1101 |
| 1042324 | N/A | N/A | 452368 | 452387 | GTGCATATATACATAGACAA | 8 | 1102 |
| 1042356 | N/A | N/A | 452666 | 452685 | GGCCCCCAAACCCATTTTCT | 114 | 1103 |
| 1042388 | N/A | N/A | 453520 | 453539 | AATATTTAAAATATTGTTGG | 120 | 1104 |
| 1042420 | N/A | N/A | 454296 | 454315 | CTGCTATAAATCAAAGACAT | 74 | 1105 |
| 1042452 | N/A | N/A | 455135 | 455154 | TAGACTTTACAAAGACTATG | 46 | 1106 |
| 1042484 | N/A | N/A | 455425 | 455444 | CTGGTGAGCCCCATTCTTTT | 39 | 1107 |
| 1042516 | N/A | N/A | 456710 | 456729 | CTGCTATTATCATACAGGAC | 18 | 1108 |

TABLE 16

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 3 | 138 |
| 1040085 | 964 | 983 | 435683 | 435702 | GTTGGATTTCATTTTTCGCC | 21 | 1109 |
| 1040117 | 2896 | 2915 | 457149 | 457168 | ATACTCTACCAAAACTTCAA | 90 | 1110 |
| 1040149 | 3411 | 3430 | 457664 | 457683 | CCACGCTGCCTCTACTTGCC | 49 | 1111 |

TABLE 16-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040181 | 4135 | 4154 | 458388 | 458407 | AGCAGAAATGAAATCCCGCA | 33 | 1112 |
| 1040213 | 4588 | 4607 | 458841 | 458860 | AGTGAGATACAGTACTTGTT | 11 | 1113 |
| 1040245 | 4889 | 4908 | 459142 | 459161 | ACTGGACAAAAATGAGTATT | 39 | 1114 |
| 1040277 | 5326 | 5345 | 459579 | 459598 | TGTACCAAACATTAAATCTC | 53 | 1115 |
| 1040309 | 5639 | 5658 | 459892 | 459911 | ACGGTTTATAAAAATCATTA | 71 | 1116 |
| 1040341 | 6066 | 6085 | 460319 | 460338 | TTGCTCCAAACCATGTGTGT | 37 | 1117 |
| 1040373 | 6641 | 6660 | 460894 | 460913 | CCACACTTCCCGTCCAGGCT | 19 | 1118 |
| 1040405 | 7293 | 7312 | 461546 | 461565 | CCAACATAGAAAATTATCCT | 27 | 1119 |
| 1040437 | 7702 | 7721 | 461955 | 461974 | AAGAGTGGATTTTATGATTA | 26 | 1120 |
| 1040469 | 8177 | 8196 | 462430 | 462449 | GGGTTAAAAACAAATGTGGA | 67 | 1121 |
| 1040501 | 8482 | 8501 | 462735 | 462754 | AGCTTCTCAAATCAGGTGTA | 14 | 1122 |
| 1040533 | 8732 | 8751 | 462985 | 463004 | CTTCCAGGCCATAACCATAC | 23 | 1123 |
| 1040565 | 9179 | 9198 | 463432 | 463451 | CTGGCCTCTTTATATTAAAT | 83 | 1124 |
| 1040597 | 9518 | 9537 | 463771 | 463790 | GAGTCCTTTCAGATAAGAAA | 18 | 1125 |
| 1040629 | 10046 | 10065 | 464299 | 464318 | CTCTGGAGCCAGGACTCCAC | 111 | 1126 |
| 1040661 | 10289 | 10308 | 464542 | 464561 | CATATGGAAAAAAGTTCTCC | 69 | 1127 |
| 1040693 | 10566 | 10585 | 464819 | 464838 | TGTACTGGTATACAGACAAT | 79 | 1128 |
| 1040725 | N/A | N/A | 21690 | 21709 | CCAATAAAAGCCACAACTTG | 101 | 1129 |
| 1040757 | N/A | N/A | 34751 | 34770 | AAGGTGTATATTTATATGTT | 9 | 1130 |
| 1040789 | N/A | N/A | 56964 | 56983 | GCTCAAATTCAAAAGATGAA | 44 | 1131 |
| 1040821 | N/A | N/A | 79281 | 79300 | TCAGTAAAACCTCAATCATT | 51 | 1132 |
| 1040853 | N/A | N/A | 100126 | 100145 | TGGAATATTCTTTATTTTGG | 68 | 1133 |
| 1040885 | N/A | N/A | 127831 | 127850 | TTACTCTTTCAAATGCAAAA | 124 | 1134 |
| 1040917 | N/A | N/A | 157778 | 157797 | AGGTTCTATATTTAGAACAC | 143 | 1135 |
| 1040949 | N/A | N/A | 181515 | 181534 | CTCACAATTCAAAAGTTGTG | 93 | 1136 |
| 1040981 | N/A | N/A | 203086 | 203105 | TTAGTCAAACATATCAACCT | 52 | 1137 |
| 1041013 | N/A | N/A | 218395 | 218414 | GGCTGCAAACTATTCAAGTA | 99 | 1138 |
| 1041045 | N/A | N/A | 242013 | 242032 | TCATTATTAGATTACCAAGA | 36 | 1139 |
| 1041077 | N/A | N/A | 263601 | 263620 | CAGTAATTTCAAAAGGGCCA | 139 | 1140 |
| 1041109 | N/A | N/A | 281523 | 281542 | TGGATGCTATTTTATGTAGA | 3 | 1141 |
| 1041141 | N/A | N/A | 304301 | 304320 | GACCACAAAACCCAACTTAC | 41 | 1142 |
| 1041173 | N/A | N/A | 329293 | 329312 | TCAACAAATCAAATACTGAT | 94 | 1143 |
| 1041205 | N/A | N/A | 350846 | 350865 | TGCTGCATATTTTATATTTA | 21 | 1144 |
| 1041237 | N/A | N/A | 375452 | 375471 | AGTGTATTAGATTAGGTCTA | 3 | 1145 |
| 1041269 | N/A | N/A | 399227 | 399246 | CTCCTTAAACCCCATTTTAT | 79 | 1146 |
| 1041301 | N/A | N/A | 430469 | 430488 | CTCCTAAAAATACATCTTAA | 129 | 1147 |

TABLE 16-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041333 | N/A | N/A | 437958 | 437977 | CCTGGTAAGAAAAAGTGCCG | 126 | 1148 |
| 1041365 | N/A | N/A | 438420 | 438439 | GTTTGCCACATTTCCCCTCA | 20 | 1149 |
| 1041397 | N/A | N/A | 438974 | 438993 | CAGAGCTAATTCCTAGGAGC | 35 | 1150 |
| 1041429 | N/A | N/A | 439254 | 439273 | GCATGTAATCGATCTAAGAA | 16 | 1151 |
| 1041461 | N/A | N/A | 439954 | 439973 | TTCAGGGCTAAAAGCTCTCG | 113 | 1152 |
| 1041493 | N/A | N/A | 440278 | 440297 | CTGTTCACAAAAATGTGTTA | 54 | 1153 |
| 1041525 | N/A | N/A | 440829 | 440848 | TCATTTAATCATTAATTTTG | 109 | 1154 |
| 1041557 | N/A | N/A | 441447 | 441466 | GATTTGCTTATTAAGCTCA | 23 | 1155 |
| 1041589 | N/A | N/A | 441816 | 441835 | GTGAGCCAATGATCCCATCA | 68 | 1156 |
| 1041621 | N/A | N/A | 442291 | 442310 | TCAGCCCCTTAAAAATCATC | 127 | 1157 |
| 1041653 | N/A | N/A | 442874 | 442893 | GGATATGTTCAGACTCAGAT | 7 | 1158 |
| 1041685 | N/A | N/A | 443223 | 443242 | CCAGTTCATACTCAGAAATA | 61 | 1159 |
| 1041717 | N/A | N/A | 443628 | 443647 | TGGCACTGAATATTAAGCAG | 52 | 1160 |
| 1041749 | N/A | N/A | 444026 | 444045 | AGTGTGTATTACCAACAACT | 13 | 1161 |
| 1041781 | N/A | N/A | 444482 | 444501 | CTGTATAATAATGTAATGCT | 6 | 1162 |
| 1041813 | N/A | N/A | 445369 | 445388 | TCTATTTAAAACACTGAATC | 88 | 1163 |
| 1041845 | N/A | N/A | 445681 | 445700 | GGGAGCAATGAATTCTCTCA | 111 | 1164 |
| 1041877 | N/A | N/A | 445946 | 445965 | CTACTATATCTAAACACTAT | 121 | 1165 |
| 1041909 | N/A | N/A | 446170 | 446189 | TTCCTCCATCCATCCCCCTA | 108 | 1166 |
| 1041941 | N/A | N/A | 446742 | 446761 | AGCCCATTTTTTCATCCAGT | 7 | 1167 |
| 1041973 | N/A | N/A | 447025 | 447044 | TGTGGCTTTACCGCCTAACA | 106 | 1168 |
| 1042005 | N/A | N/A | 447997 | 448016 | TCTCCTCTTTATACCAGGGA | 47 | 1169 |
| 1042037 | N/A | N/A | 448611 | 448630 | TATTTTTTACTACCTCCAC | 72 | 1170 |
| 1042069 | N/A | N/A | 448882 | 448901 | AGTGACCACACTATCCGATG | 28 | 1171 |
| 1042101 | N/A | N/A | 449428 | 449447 | CTTGAATTTAAAACCCATAT | 83 | 1172 |
| 1042133 | N/A | N/A | 449745 | 449764 | TGCACACATCTCAAATAGGT | 40 | 1173 |
| 1042165 | N/A | N/A | 450037 | 450056 | TTTGCCTAAATTCTGCCTTT | 68 | 1174 |
| 1042197 | N/A | N/A | 450727 | 450746 | CTCACCAACCTCATCTCTCG | 98 | 1175 |
| 1042229 | N/A | N/A | 451449 | 451468 | ACAACTAACTATATATTGTT | 97 | 1176 |
| 1042261 | N/A | N/A | 451738 | 451757 | GTTTCCCTCTAAAGACTTCA | 17 | 1177 |
| 1042293 | N/A | N/A | 452058 | 452077 | GACCAGAAGCCTTAGTTCCA | 26 | 1178 |
| 1042325 | N/A | N/A | 452384 | 452403 | ACACAGAAACATATATGTGC | 87 | 1179 |
| 1042357 | N/A | N/A | 452669 | 452688 | ATTGGCCCCAAACCCATTT | 83 | 1180 |
| 1042389 | N/A | N/A | 453547 | 453566 | TCTGAATGAATATTGGCTAT | 21 | 1181 |
| 1042421 | N/A | N/A | 454309 | 454328 | GATGAGAATTAAACTGCTAT | 66 | 1182 |
| 1042453 | N/A | N/A | 455147 | 455166 | GAGTCATACATATAGACTTT | 132 | 1183 |

TABLE 16-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1042485 | N/A | N/A | 455452 | 455471 | TCAGGATACACCAAGGGAGG | 82 | 1184 |
| 1042517 | N/A | N/A | 456712 | 456731 | AACTGCTATTATCATACAGG | 57 | 1185 |

TABLE 17

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 3 | 138 |
| 1040086 | 1112 | 1131 | 435831 | 435850 | CCCGGCCACCAGGGTTGCCC | 110 | 1186 |
| 1040118 | 2897 | 2916 | 457150 | 457169 | GATACTCTACCAAAACTTCA | 64 | 1187 |
| 1040150 | 3412 | 3431 | 457665 | 457684 | CCCACGCTGCCTCTACTTGC | 56 | 1188 |
| 1040182 | 4147 | 4166 | 458400 | 458419 | GCACTAGTAAAAGCAGAAA | 72 | 1189 |
| 1040214 | 4594 | 4613 | 458847 | 458866 | GTTTAAAGTGAGATACAGTA | 15 | 1190 |
| 1040246 | 4923 | 4942 | 459176 | 459195 | AGGTTCTTTAAAAGTTCATC | 12 | 1191 |
| 1040278 | 5330 | 5349 | 459583 | 459602 | GGTTTGTACCAAACATTAAA | 106 | 1192 |
| 1040310 | 5652 | 5671 | 459905 | 459924 | TACACCCCAGAAAACGGTTT | 124 | 1193 |
| 1040342 | 6069 | 6088 | 460322 | 460341 | CTATTGCTCCAAACCATGTG | 39 | 1194 |
| 1040374 | 6678 | 6697 | 460931 | 460950 | ACTGGCCAACACGCTCAGAA | 102 | 1195 |
| 1040406 | 7294 | 7313 | 461547 | 461566 | ACCAACATAGAAAATTATCC | 30 | 1196 |
| 1040438 | 7722 | 7741 | 461975 | 461994 | AGTAAAGATCAAACTGTGCA | 14 | 1197 |
| 1040470 | 8178 | 8197 | 462431 | 462450 | TGGGTTAAAAACAAATGTGG | 81 | 1198 |
| 1040502 | 8484 | 8503 | 462737 | 462756 | TCAGCTTCTCAAATCAGGTG | 13 | 1199 |
| 1040534 | 8740 | 8759 | 462993 | 463012 | TAGTAATTCTTCCAGGCCAT | 23 | 1200 |
| 1040566 | 9181 | 9200 | 463434 | 463453 | TTCTGGCCTCTTTATATTAA | 30 | 1201 |
| 1040598 | 9521 | 9540 | 463774 | 463793 | CTTGAGTCCTTTCAGATAAG | 28 | 1202 |
| 1040630 | 10087 | 10106 | 464340 | 464359 | TCTGATATTAAAACATCCAG | 34 | 1203 |
| 1040662 | 10290 | 10309 | 464543 | 464562 | GCATATGGAAAAAGTTCTC | 24 | 1204 |
| 1040694 | 10583 | 10602 | 464836 | 464855 | TACTGAAACAATAAACTTGT | 102 | 1205 |
| 1040726 | N/A | N/A | 22134 | 22153 | TCTTCCTCCTTTTATATCTG | 30 | 1206 |
| 1040758 | N/A | N/A | 34802 | 34821 | GGATTAAAATTATGACCTC | 57 | 1207 |
| 1040790 | N/A | N/A | 59689 | 59708 | GGAGCAGTTCCTTAACTATC | 20 | 1208 |
| 1040822 | N/A | N/A | 79548 | 79567 | CCCCTTACCCAAACCCTTGG | 124 | 1209 |
| 1040854 | N/A | N/A | 102583 | 102602 | AGAGATAATTTTTAATGCAG | 34 | 1210 |
| 1040886 | N/A | N/A | 129211 | 129230 | CCATTAAACATTTATTTTGC | 11 | 1211 |
| 1040918 | N/A | N/A | 158178 | 158197 | TCTATATTCCCTTAACCGTA | 32 | 1212 |

TABLE 17-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040950 | N/A | N/A | 182959 | 182978 | CATTTTCAACCTTATGATAT | 42 | 1213 |
| 1040982 | N/A | N/A | 203492 | 203511 | CAGACATTCCTTTAATATGC | 17 | 1214 |
| 1041014 | N/A | N/A | 218412 | 218431 | TAGAACTTTTAAAGCAAGGC | 52 | 1215 |
| 1041046 | N/A | N/A | 242061 | 242080 | AGTCAAATAGTCTATCAGTA | 11 | 1216 |
| 1041078 | N/A | N/A | 263847 | 263866 | ACATGATTTTAAAAGTCTTA | 73 | 1217 |
| 1041110 | N/A | N/A | 281874 | 281893 | TCCCCACACCCTTAAACTGC | 115 | 1218 |
| 1041142 | N/A | N/A | 310242 | 310261 | TACACATAAATTTATATCTG | 78 | 1219 |
| 1041174 | N/A | N/A | 329490 | 329509 | TGGTTCTATATTTATGTACC | 25 | 1220 |
| 1041206 | N/A | N/A | 353449 | 353468 | TTGTCTAAACCTGTTTGAGG | 6 | 1221 |
| 1041238 | N/A | N/A | 375665 | 375684 | GCTACCAAAATACAGAACTT | 66 | 1222 |
| 1041270 | N/A | N/A | 399709 | 399728 | GCACCATTTTAAAAATGGCT | 123 | 1223 |
| 1041302 | N/A | N/A | 430826 | 430845 | TCATCTAAACCTAATACGGC | 99 | 1224 |
| 1041334 | N/A | N/A | 437968 | 437987 | TCTGTCTTTTCCTGGTAAGA | 11 | 1225 |
| 1041366 | N/A | N/A | 438425 | 438444 | CTGTTGTTTGCCACATTTCC | 9 | 1226 |
| 1041398 | N/A | N/A | 438975 | 438994 | CCAGAGCTAATTCCTAGGAG | 4 | 1227 |
| 1041430 | N/A | N/A | 439288 | 439307 | TTGGGCAGTGAAAGAAATGG | 74 | 1228 |
| 1041462 | N/A | N/A | 439989 | 440008 | ACCTACAGTGACATCTCATA | 63 | 1229 |
| 1041494 | N/A | N/A | 440279 | 440298 | TCTGTTCACAAAAATGTGTT | 94 | 1230 |
| 1041526 | N/A | N/A | 440834 | 440853 | CTCTTTCATTTAATCATTAA | 47 | 1231 |
| 1041558 | N/A | N/A | 441464 | 441483 | TCCCCAATCAAATTTGTGAT | 62 | 1232 |
| 1041590 | N/A | N/A | 441897 | 441916 | GTAGTGGTACACACCCATAG | 77 | 1233 |
| 1041622 | N/A | N/A | 442320 | 442339 | GGCATCTTTCCACAGTCTTA | 43 | 1234 |
| 1041654 | N/A | N/A | 442947 | 442966 | CCGAGCCATCTAAGTTGAAG | 30 | 1235 |
| 1041686 | N/A | N/A | 443225 | 443244 | ATCCAGTTCATACTCAGAAA | 29 | 1236 |
| 1041718 | N/A | N/A | 443659 | 443678 | CACCCACGCCAGGACAGTCG | 128 | 1237 |
| 1041750 | N/A | N/A | 444049 | 444068 | TTCAGCACCAGAACAGACA | 116 | 1238 |
| 1041782 | N/A | N/A | 444483 | 444502 | TCTGTATAATAATGTAATGC | 11 | 1239 |
| 1041814 | N/A | N/A | 445371 | 445390 | GTTCTATTTAAAACACTGAA | 25 | 1240 |
| 1041846 | N/A | N/A | 445703 | 445722 | CATACAAATTTCGCCTGTTG | 55 | 1241 |
| 1041878 | N/A | N/A | 445947 | 445966 | ACTACTATATCTAAACACTA | 109 | 1242 |
| 1041910 | N/A | N/A | 446176 | 446195 | TACCCCTTCCTCCATCCATC | 88 | 1243 |
| 1041942 | N/A | N/A | 446750 | 446769 | CTCAATATAGCCCATTTTTT | 47 | 1244 |
| 1041974 | N/A | N/A | 447063 | 447082 | GACCTCCCCAGGGAGAGGA | 75 | 1245 |
| 1042006 | N/A | N/A | 447998 | 448017 | TTCTCCTCTTTATACCAGGG | 12 | 1246 |
| 1042038 | N/A | N/A | 448613 | 448632 | ACTATTTTTTACTACCTCC | 54 | 1247 |
| 1042070 | N/A | N/A | 448885 | 448904 | ACCAGTGACCACACTATCCG | 45 | 1248 |
| 1042102 | N/A | N/A | 449429 | 449448 | CCTTGAATTTAAAACCCATA | 42 | 1249 |

TABLE 17-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1042134 | N/A | N/A | 449762 | 449781 | GAAAGTTAAAATCTTGTTGC | 57 | 1250 |
| 1042166 | N/A | N/A | 450040 | 450059 | CTTTTTGCCTAAATTCTGCC | 70 | 1251 |
| 1042198 | N/A | N/A | 450728 | 450747 | TCTCACCAACCTCATCTCTC | 77 | 1252 |
| 1042230 | N/A | N/A | 451450 | 451469 | AACAACTAACTATATATTGT | 112 | 1253 |
| 1042262 | N/A | N/A | 451767 | 451786 | AGTGCAAAAGTCAGGATACA | 12 | 1254 |
| 1042294 | N/A | N/A | 452064 | 452083 | TCAGAAGACCAGAAGCCTTA | 62 | 1255 |
| 1042326 | N/A | N/A | 452397 | 452416 | ACATTTACATCACACACAGA | 104 | 1256 |
| 1042358 | N/A | N/A | 452685 | 452704 | GGATTTTATCCCAGTCATTG | 57 | 1257 |
| 1042390 | N/A | N/A | 453577 | 453596 | GAGGAATGAAAATGGTAGAT | 25 | 1258 |
| 1042422 | N/A | N/A | 454311 | 454330 | CAGATGAGAATTAAACTGCT | 62 | 1259 |
| 1042454 | N/A | N/A | 455148 | 455167 | AGAGTCATACATATAGACTT | 129 | 1260 |
| 1042486 | N/A | N/A | 455459 | 455478 | ATGGAGTTCAGGATACACCA | 54 | 1261 |
| 1042518 | N/A | N/A | 456740 | 456759 | GGTCTTAGATTTTATGAGCT | 16 | 1262 |

TABLE 18

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 3 | 138 |
| 1040087 | 1115 | 1134 | 435834 | 435853 | GGCCCCGGCCACCAGGGTTG | 104 | 1263 |
| 1040119 | 2898 | 2917 | 457151 | 457170 | GGATACTCTACCAAAACTTC | 20 | 1264 |
| 1040151 | 3423 | 3442 | 457676 | 457695 | GTTTCCTTTCCCCCACGCTG | 23 | 1265 |
| 1040183 | 4148 | 4167 | 458401 | 458420 | TGCACTAGTAAAAGCAGAA | 99 | 1266 |
| 1040215 | 4609 | 4628 | 458862 | 458881 | TTTTTTCCCCAAAGAGTTTA | 37 | 1267 |
| 1040247 | 4924 | 4943 | 459177 | 459196 | AAGGTTCTTTAAAAGTTCAT | 20 | 1268 |
| 1040279 | 5332 | 5351 | 459585 | 459604 | TGGGTTTGTACCAAACATTA | 59 | 1269 |
| 1040311 | 5676 | 5695 | 459929 | 459948 | CTAAACCTATTCAAATGTTT | 90 | 1270 |
| 1040343 | 6078 | 6097 | 460331 | 460350 | ATGATGTTCCTATTGCTCCA | 11 | 1271 |
| 1040375 | 6750 | 6769 | 461003 | 461022 | TCTTCCTATTTGAAGAGAAA | 64 | 1272 |
| 1040407 | 7311 | 7330 | 461564 | 461583 | GGGAAAACGAAAAGTTGACC | 29 | 1273 |
| 1040439 | 7724 | 7743 | 461977 | 461996 | TCAGTAAAGATCAAACTGTG | 103 | 1274 |
| 1040471 | 8180 | 8199 | 462433 | 462452 | TCTGGGTTAAAAACAAATGT | 69 | 1275 |
| 1040503 | 8486 | 8505 | 462739 | 462758 | CTTCAGCTTCTCAAATCAGG | 26 | 1276 |
| 1040535 | 8767 | 8786 | 463020 | 463039 | ATAGGTATAGTTTAAGAGCC | 22 | 1277 |
| 1040567 | 9195 | 9214 | 463448 | 463467 | ATGCTCCGTATTTATTCTGG | 9 | 1278 |

TABLE 18 -continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040599 | 9523 | 9542 | 463776 | 463795 | GACTTGAGTCCTTTCAGATA | 32 | 1279 |
| 1040631 | 10088 | 10107 | 464341 | 464360 | ATCTGATATTAAAACATCCA | 33 | 1280 |
| 1040663 | 10327 | 10346 | 464580 | 464599 | TACAATATTTTACACTGGAA | 11 | 1281 |
| 1040695 | 10609 | 10628 | 464862 | 464881 | GCACTGTTATTTTATTAGTA | 41 | 1282 |
| 1040727 | N/A | N/A | 22675 | 22694 | CTGTGGTTTTAAAGGCTGTA | 4 | 1283 |
| 1040759 | N/A | N/A | 34869 | 34888 | GGTTTTAAAAACATCCTCCT | 41 | 1284 |
| 1040791 | N/A | N/A | 63051 | 63070 | TTTTAGCACCTTTAAACTCT | 85 | 1285 |
| 1040823 | N/A | N/A | 79759 | 79778 | CTCTCATTTTAAAGTTTTCT | 44 | 1286 |
| 1040855 | N/A | N/A | 103256 | 103275 | ATCTTTATTCAAAAATGCAA | 88 | 1287 |
| 1040887 | N/A | N/A | 132848 | 132867 | TTCATGTTTTAAAGCTGAGA | 11 | 1288 |
| 1040919 | N/A | N/A | 158451 | 158470 | CTCACAATTCAAAATTATTC | 44 | 1289 |
| 1040951 | N/A | N/A | 182994 | 183013 | AACCTTAGAAATGTACATTT | 29 | 1290 |
| 1040983 | N/A | N/A | 204258 | 204277 | CTAGCAATTCAAAACAATAT | 45 | 1291 |
| 1041015 | N/A | N/A | 219043 | 219062 | CTTCTCCTTCCTTAATAGAT | 65 | 1292 |
| 1041047 | N/A | N/A | 243398 | 243417 | TCTCAAGGCCCTTAATTGCC | 67 | 1293 |
| 1041079 | N/A | N/A | 264140 | 264159 | ACTTTTAAATCCCCCTAAAG | 105 | 1294 |
| 1041111 | N/A | N/A | 281939 | 281958 | CTCACATTTCTTTATACACA | 2 | 1295 |
| 1041143 | N/A | N/A | 311352 | 311371 | GTGAGATTTTAAAGACATTC | 1 | 1296 |
| 1041175 | N/A | N/A | 330016 | 330035 | GATGCCAAACTATTATCTCA | 7 | 1297 |
| 1041207 | N/A | N/A | 354249 | 354268 | AGACAATTTTAAAAGCTTCC | 8 | 1298 |
| 1041239 | N/A | N/A | 375816 | 375835 | TCTCTTAACCAAAGAATCTG | 132 | 1299 |
| 1041271 | N/A | N/A | 400962 | 400981 | ATGCTGTTCCTTTATAACGG | 16 | 1300 |
| 1041303 | N/A | N/A | 431185 | 431204 | AATTTCTAAATTTAGCCCAG | 55 | 1301 |
| 1041335 | N/A | N/A | 437990 | 438009 | TCCCCTCACTCCAACGGCAT | 80 | 1302 |
| 1041367 | N/A | N/A | 438448 | 438467 | CTCCCATGAAACCACAATAA | 142 | 1303 |
| 1041399 | N/A | N/A | 439002 | 439021 | CTGACTTTTATATGCAAACC | 25 | 1304 |
| 1041431 | N/A | N/A | 439344 | 439363 | CTCGATAGCCAGGAAAGCTC | 64 | 1305 |
| 1041463 | N/A | N/A | 439996 | 440015 | ACTGTAAACCTACAGTGACA | 130 | 1306 |
| 1041495 | N/A | N/A | 440280 | 440299 | CTCTGTTCACAAAAATGTGT | 95 | 1307 |
| 1041527 | N/A | N/A | 440836 | 440855 | TTCTCTTTCATTTAATCATT | 16 | 1308 |
| 1041559 | N/A | N/A | 441465 | 441484 | TTCCCCAATCAAATTTGTGA | 83 | 1309 |
| 1041591 | N/A | N/A | 442071 | 442090 | GAGATTATCTCCTATGAAGA | 50 | 1310 |
| 1041623 | N/A | N/A | 442374 | 442393 | AGCATTTTCTCCTACATTG | 14 | 1311 |
| 1041655 | N/A | N/A | 442950 | 442969 | GGCCCGAGCCATCTAAGTTG | 129 | 1312 |
| 1041687 | N/A | N/A | 443226 | 443245 | AATCCAGTTCATACTCAGAA | 47 | 1313 |
| 1041719 | N/A | N/A | 443664 | 443683 | ACTCACACCCACGCCAGGAC | 109 | 1314 |
| 1041751 | N/A | N/A | 444094 | 444113 | CCACAAACAAAAATGTGGTT | 79 | 1315 |

TABLE 18 -continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041783 | N/A | N/A | 444487 | 444506 | CTGTTCTGTATAATAATGTA | 48 | 1316 |
| 1041815 | N/A | N/A | 445372 | 445391 | TGTTCTATTTAAAACACTGA | 62 | 1317 |
| 1041847 | N/A | N/A | 445705 | 445724 | GACATACAAATTTCGCCTGT | 22 | 1318 |
| 1041879 | N/A | N/A | 445948 | 445967 | AACTACTATATCTAAACACT | 95 | 1319 |
| 1041911 | N/A | N/A | 446181 | 446200 | CTGCCTACCCCTTCCTCCAT | 80 | 1320 |
| 1041943 | N/A | N/A | 446755 | 446774 | GACAGCTCAATATAGCCCAT | 28 | 1321 |
| 1041975 | N/A | N/A | 447085 | 447104 | AGCCAGAACTAAAGTGGGCT | 74 | 1322 |
| 1042007 | N/A | N/A | 448000 | 448019 | CCTTCTCCTCTTTATACCAG | 35 | 1323 |
| 1042039 | N/A | N/A | 448615 | 448634 | ATACTATTTTTTTACTACCT | 65 | 1324 |
| 1042071 | N/A | N/A | 448888 | 448907 | GACACCAGTGACCACACTAT | 46 | 1325 |
| 1042103 | N/A | N/A | 449430 | 449449 | TCCTTGAATTTAAAACCCAT | 55 | 1326 |
| 1042135 | N/A | N/A | 449763 | 449782 | TGAAAGTTAAAATCTTGTTG | 75 | 1327 |
| 1042167 | N/A | N/A | 450041 | 450060 | TCTTTTTGCCTAAATTCTGC | 43 | 1328 |
| 1042199 | N/A | N/A | 450731 | 450750 | TCCTCTCACCAACCTCATCT | 77 | 1329 |
| 1042231 | N/A | N/A | 451490 | 451509 | CTTTTAGAAACTAACTCTGG | 107 | 1330 |
| 1042263 | N/A | N/A | 451782 | 451801 | GTACTATAATTGATTAGTGC | 50 | 1331 |
| 1042295 | N/A | N/A | 452071 | 452090 | GTGACATTCAGAAGACCAGA | 15 | 1332 |
| 1042327 | N/A | N/A | 452400 | 452419 | ACTACATTTACATCACACAC | 83 | 1333 |
| 1042359 | N/A | N/A | 452688 | 452707 | TTAGGATTTTATCCCAGTCA | 28 | 1334 |
| 1042391 | N/A | N/A | 453658 | 453677 | GCATTATAGAAAATACTAAA | 85 | 1335 |
| 1042423 | N/A | N/A | 454312 | 454331 | GCAGATGAGAATTAAACTGC | 100 | 1336 |
| 1042455 | N/A | N/A | 455154 | 455173 | TCATATAGAGTCATACATAT | 45 | 1337 |
| 1042487 | N/A | N/A | 455532 | 455551 | TGAACATTCCAAAGTGGAGC | 44 | 1338 |
| 1042519 | N/A | N/A | 456742 | 456761 | GCGGTCTTAGATTTTATGAG | 24 | 1339 |

TABLE 19

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 3 | 138 |
| 1040088 | 1144 | 1163 | 435863 | 435882 | CCCTGCCGGCCCATGCCTCC | 159 | 1340 |
| 1040120 | 2908 | 2927 | 457161 | 457180 | CACAAAAAAGGATACTCTA | 104 | 1341 |
| 1040152 | 3453 | 3472 | 457706 | 457725 | ATCTGGATACAAATGATAAG | 50 | 1342 |
| 1040184 | 4176 | 4195 | 458429 | 458448 | GTCCACCACAACACCCTGGT | 78 | 1343 |
| 1040216 | 4671 | 4690 | 458924 | 458943 | CAGAGCTGAAATGTAGTTAC | 12 | 1344 |

TABLE 19-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040248 | 4926 | 4945 | 459179 | 459198 | GCAAGGTTCTTTAAAAGTTC | 11 | 1345 |
| 1040280 | 5347 | 5366 | 459600 | 459619 | ATGAAATACCCTTTCTGGGT | 124 | 1346 |
| 1040312 | 5684 | 5703 | 459937 | 459956 | TAGCTATTCTAAACCTATTC | 140 | 1347 |
| 1040344 | 6080 | 6099 | 460333 | 460352 | TGATGATGTTCCTATTGCTC | 15 | 1348 |
| 1040376 | 6870 | 6889 | 461123 | 461142 | GAAGAATTTCTACCCCTGTC | 39 | 1349 |
| 1040408 | 7336 | 7355 | 461589 | 461608 | ATCCCAAACTAAACTGGGTG | 105 | 1350 |
| 1040440 | 7732 | 7751 | 461985 | 462004 | AACATATTTCAGTAAAGATC | 13 | 1351 |
| 1040472 | 8194 | 8213 | 462447 | 462466 | TCTATTTCAGAAATTCTGGG | 11 | 1352 |
| 1040504 | 8505 | 8524 | 462758 | 462777 | TGCTTCAAAATTTTGTTTTC | 40 | 1353 |
| 1040536 | 8815 | 8834 | 463068 | 463087 | TTCCCTCCCTCAGACGAGG | 109 | 1354 |
| 1040568 | 9206 | 9225 | 463459 | 463478 | ATTCTGAGAAGATGCTCCGT | 35 | 1355 |
| 1040600 | 9525 | 9544 | 463778 | 463797 | AAGACTTGAGTCCTTTCAGA | 26 | 1356 |
| 1040632 | 10089 | 10108 | 464342 | 464361 | GATCTGATATTAAAACATCC | 20 | 1357 |
| 1040664 | 10329 | 10348 | 464582 | 464601 | AGTACAATATTTTACACTGG | 14 | 1358 |
| 1040696 | N/A | N/A | 5825 | 5844 | GTCAAGTTTTAAAATGTGAC | 68 | 1359 |
| 1040728 | N/A | N/A | 22774 | 22793 | ACTGAAACAATTTATCTAAG | 83 | 1360 |
| 1040760 | N/A | N/A | 36098 | 36117 | ACAAAAATAATTTAAGCCAC | 106 | 1361 |
| 1040792 | N/A | N/A | 63073 | 63092 | TACTATCACCTTTAAACTTT | 71 | 1362 |
| 1040824 | N/A | N/A | 80953 | 80972 | ACCGCCAAAACCAACCAGGG | 65 | 1363 |
| 1040856 | N/A | N/A | 103405 | 103424 | CTAATCTATCAAATAAAGGA | 105 | 1364 |
| 1040888 | N/A | N/A | 133117 | 133136 | GAGAGGTTTCATTATGTAAA | 5 | 1365 |
| 1040920 | N/A | N/A | 158507 | 158526 | GCACTTAGACAATGCTGCAG | 106 | 1366 |
| 1040952 | N/A | N/A | 183278 | 183297 | GGTAAGTTATTTTAAAACTT | 76 | 1367 |
| 1040984 | N/A | N/A | 205648 | 205667 | AGTTTTACGATATATGAATC | 81 | 1368 |
| 1041016 | N/A | N/A | 219199 | 219218 | TACCATTATTTTTAGCTTTT | 18 | 1369 |
| 1041048 | N/A | N/A | 243460 | 243479 | CAGTTTATTCTTTACCCAAA | 10 | 1370 |
| 1041080 | N/A | N/A | 264569 | 264588 | CCCACATTTTAAAGATGCAG | 46 | 1371 |
| 1041112 | N/A | N/A | 282392 | 282411 | TCCAGAAACCTTTATTATTG | 1 | 1372 |
| 1041144 | N/A | N/A | 311667 | 311686 | AACAGGTTACAAATACGGTT | 1 | 1373 |
| 1041176 | N/A | N/A | 330322 | 330341 | ATTCTGTTTTAAATTCCTTT | 1 | 1374 |
| 1041208 | N/A | N/A | 354293 | 354312 | ATGCAATTTCAAAAGCTGGC | 10 | 1375 |
| 1041240 | N/A | N/A | 376063 | 376082 | GTGGATACTTTTTAAAACTC | 2 | 1376 |
| 1041272 | N/A | N/A | 401167 | 401186 | GTCGCAAACCTTTATGGAGT | 6 | 1377 |
| 1041304 | N/A | N/A | 431998 | 432017 | CAAATCCAAATTTATTCTTC | 76 | 1378 |
| 1041336 | N/A | N/A | 437997 | 438016 | CATCTAATCCCCTCACTCCA | 92 | 1379 |
| 1041368 | N/A | N/A | 438450 | 438469 | GCCTCCCATGAAACCACAAT | 122 | 1380 |
| 1041400 | N/A | N/A | 439003 | 439022 | CCTGACTTTTATATGCAAAC | 11 | 1381 |

TABLE 19-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041432 | N/A | N/A | 439351 | 439370 | AAGTACGCTCGATAGCCAGG | 22 | 1382 |
| 1041464 | N/A | N/A | 439999 | 440018 | AAGACTGTAAACCTACAGTG | 101 | 1383 |
| 1041496 | N/A | N/A | 440281 | 440300 | CCTCTGTTCACAAAAATGTG | 121 | 1384 |
| 1041528 | N/A | N/A | 440838 | 440857 | ATTTCTCTTTCATTTAATCA | 33 | 1385 |
| 1041560 | N/A | N/A | 441466 | 441485 | CTTCCCCAATCAAATTTGTG | 87 | 1386 |
| 1041592 | N/A | N/A | 442072 | 442091 | AGAGATTATCTCCTATGAAG | 70 | 1387 |
| 1041624 | N/A | N/A | 442397 | 442416 | AGGGATAGTGACAAACACGG | 8 | 1388 |
| 1041656 | N/A | N/A | 442952 | 442971 | AGGGCCCGAGCCATCTAAGT | 122 | 1389 |
| 1041688 | N/A | N/A | 443233 | 443252 | CCCCTCAAATCCAGTTCATA | 111 | 1390 |
| 1041720 | N/A | N/A | 443705 | 443724 | CATCATGATAACAACTGCTG | 47 | 1391 |
| 1041752 | N/A | N/A | 444095 | 444114 | CCCACAAACAAAAATGTGGT | 100 | 1392 |
| 1041784 | N/A | N/A | 444575 | 444594 | GAGTAAAATGATCAGTGGGT | 15 | 1393 |
| 1041816 | N/A | N/A | 445373 | 445392 | GTGTTCTATTTAAAACACTG | 107 | 1394 |
| 1041848 | N/A | N/A | 445706 | 445725 | AGACATACAAATTTCGCCTG | 45 | 1395 |
| 1041880 | N/A | N/A | 445954 | 445973 | GTCAATAACTACTATATCTA | 54 | 1396 |
| 1041912 | N/A | N/A | 446182 | 446201 | TCTGCCTACCCCTTCCTCCA | 61 | 1397 |
| 1041944 | N/A | N/A | 446788 | 446807 | CCACAGATAACCAAAGCACG | 37 | 1398 |
| 1041976 | N/A | N/A | 447087 | 447106 | CCAGCCAGAACTAAAGTGGG | 75 | 1399 |
| 1042008 | N/A | N/A | 448004 | 448023 | GGCCCCTTCTCCTCTTTATA | 118 | 1400 |
| 1042040 | N/A | N/A | 448617 | 448636 | TGATACTATTTTTTACTAC | 97 | 1401 |
| 1042072 | N/A | N/A | 448922 | 448941 | GAGACAGAACATACACGCAA | 35 | 1402 |
| 1042104 | N/A | N/A | 449432 | 449451 | ATTCCTTGAATTTAAAACCC | 51 | 1403 |
| 1042136 | N/A | N/A | 449764 | 449783 | GTGAAAGTTAAAATCTTGTT | 47 | 1404 |
| 1042168 | N/A | N/A | 450045 | 450064 | TGTTTCTTTTTGCCTAAATT | 13 | 1405 |
| 1042200 | N/A | N/A | 450734 | 450753 | TTTTCCTCTCACCAACCTCA | 67 | 1406 |
| 1042232 | N/A | N/A | 451491 | 451510 | ACTTTTAGAAACTAACTCTG | 71 | 1407 |
| 1042264 | N/A | N/A | 451796 | 451815 | GCCCTTTATAACAGGTACTA | 44 | 1408 |
| 1042296 | N/A | N/A | 452072 | 452091 | TGTGACATTCAGAAGACCAG | 27 | 1409 |
| 1042328 | N/A | N/A | 452405 | 452424 | TCAAAACTACATTTACATCA | 118 | 1410 |
| 1042360 | N/A | N/A | 452691 | 452710 | GGTTTAGGATTTTATCCCAG | 25 | 1411 |
| 1042392 | N/A | N/A | 453659 | 453678 | TGCATTATAGAAAATACTAA | 121 | 1412 |
| 1042424 | N/A | N/A | 454313 | 454332 | GGCAGATGAGAATTAAACTG | 38 | 1413 |
| 1042456 | N/A | N/A | 455163 | 455182 | CAGGGCTTCTCATATAGAGT | 31 | 1414 |
| 1042488 | N/A | N/A | 455538 | 455557 | GGCACTTGAACATTCCAAAG | 10 | 1415 |
| 1042520 | N/A | N/A | 456757 | 456776 | GCTCACAAGCCCAGCGCGGT | 90 | 1416 |

TABLE 20

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 3 | 138 |
| 1040089 | 1170 | 1189 | 435889 | 435908 | TGTTGTAAACCAAGCTCCAC | 56 | 1417 |
| 1040121 | 2915 | 2934 | 457168 | 457187 | GTCCAAACACAAAAAAGGA | 90 | 1418 |
| 1040153 | 3475 | 3494 | 457728 | 457747 | TATTTTAGCCTACAGTACAG | 70 | 1419 |
| 1040185 | 4179 | 4198 | 458432 | 458451 | CCTGTCCACCACAACACCCT | 80 | 1420 |
| 1040217 | 4683 | 4702 | 458936 | 458955 | TCAGCAATTCTGCAGAGCTG | 103 | 1421 |
| 1040249 | 4953 | 4972 | 459206 | 459225 | AAGTTATAAACTCAATATGT | 38 | 1422 |
| 1040281 | 5348 | 5367 | 459601 | 459620 | TATGAAATACCCTTTCTGGG | 106 | 1423 |
| 1040313 | 5686 | 5705 | 459939 | 459958 | TCTAGCTATTCTAAACCTAT | 80 | 1424 |
| 1040345 | 6092 | 6111 | 460345 | 460364 | CCACAAAAATTATGATGATG | 45 | 1425 |
| 1040377 | 6871 | 6890 | 461124 | 461143 | CGAAGAATTTCTACCCCTGT | 47 | 1426 |
| 1040409 | 7338 | 7357 | 461591 | 461610 | TCATCCCAAACTAAACTGGG | 87 | 1427 |
| 1040441 | 7734 | 7753 | 461987 | 462006 | GCAACATATTTCAGTAAAGA | 13 | 1428 |
| 1040473 | 8203 | 8222 | 462456 | 462475 | CTTAAATTCTCTATTTCAGA | 30 | 1429 |
| 1040505 | 8506 | 8525 | 462759 | 462778 | GTGCTTCAAAATTTTGTTTT | 27 | 1430 |
| 1040537 | 8821 | 8840 | 463074 | 463093 | ACCGAGTTCCCCTCCCTCAG | 106 | 1431 |
| 1040569 | 9217 | 9236 | 463470 | 463489 | ACAGGAATACTATTCTGAGA | 38 | 1432 |
| 1040601 | 9550 | 9569 | 463803 | 463822 | GAAGCCTCCAATGTATCTGC | 17 | 1433 |
| 1040633 | 10134 | 10153 | 464387 | 464406 | GGTGTCTGTTTTCCCTTGGC | 14 | 1434 |
| 1040665 | 10330 | 10349 | 464583 | 464602 | AAGTACAATATTTTACACTG | 20 | 1435 |
| 1040697 | N/A | N/A | 6321 | 6340 | GGCCATAAAATTGTAAACTG | 44 | 1436 |
| 1040729 | N/A | N/A | 23146 | 23165 | AACATCTAAATTTATAATGA | 113 | 1437 |
| 1040761 | N/A | N/A | 36881 | 36900 | AGGTGGTTACAAACATAAAT | 35 | 1438 |
| 1040793 | N/A | N/A | 63098 | 63117 | AGCTAAAAACCCAACATGGG | 81 | 1439 |
| 1040825 | N/A | N/A | 81039 | 81058 | GACAGTTATTTTAAGAGGC | 7 | 1440 |
| 1040857 | N/A | N/A | 103451 | 103470 | TTGGACTTTTAAATGTAAGT | 83 | 1441 |
| 1040889 | N/A | N/A | 135046 | 135065 | TGTGTCTAAATTTATGGTAG | 13 | 1442 |
| 1040921 | N/A | N/A | 160360 | 160379 | GTTGAATTTCAAAAATCAAA | 59 | 1443 |
| 1040953 | N/A | N/A | 184290 | 184309 | CAGGAAAAAATACAGGGTGT | 19 | 1444 |
| 1040985 | N/A | N/A | 206209 | 206228 | ACCTAAAAAATATAGATCC | 142 | 1445 |
| 1041017 | N/A | N/A | 223097 | 223116 | CTAATTAATCCTTAAATTGC | 109 | 1446 |
| 1041049 | N/A | N/A | 244961 | 244980 | TTTCAATATATTTACACACT | 63 | 1447 |
| 1041081 | N/A | N/A | 266459 | 266478 | CTCACACAAATTTACATTCT | 89 | 1448 |
| 1041113 | N/A | N/A | 284256 | 284275 | ACCTAAAAAATACATCTTTA | 94 | 1449 |
| 1041145 | N/A | N/A | 313344 | 313363 | CTGAAGATTCCTTAATATCT | 1 | 1450 |
| 1041177 | N/A | N/A | 331091 | 331110 | CTAATGTTTTAAAACTCTTG | 35 | 1451 |
| 1041209 | N/A | N/A | 355246 | 355265 | TTCCAATTTTAAAAAACCTG | 44 | 1452 |

TABLE 20-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041241 | N/A | N/A | 376190 | 376209 | CTGTCAAAAATATAATACCT | 81 | 1453 |
| 1041273 | N/A | N/A | 401168 | 401187 | TGTCGCAAACCTTTATGGAG | 33 | 1454 |
| 1041305 | N/A | N/A | 432296 | 432315 | AAGTCCTTTCAAAGCCAAGT | 38 | 1455 |
| 1041337 | N/A | N/A | 437999 | 438018 | AGCATCTAATCCCCTCACTC | 42 | 1456 |
| 1041369 | N/A | N/A | 438464 | 438483 | AACCCGTTTACCCTGCCTCC | 77 | 1457 |
| 1041401 | N/A | N/A | 439004 | 439023 | GCCTGACTTTTATATGCAAA | 13 | 1458 |
| 1041433 | N/A | N/A | 439362 | 439381 | ACACTTGTAGAAAGTACGCT | 8 | 1459 |
| 1041465 | N/A | N/A | 440005 | 440024 | CTTCCAAAGACTGTAAACCT | 65 | 1460 |
| 1041497 | N/A | N/A | 440282 | 440301 | GCCTCTGTTCACAAAAATGT | 99 | 1461 |
| 1041529 | N/A | N/A | 440844 | 440863 | AAGCCAATTTCTCTTTCATT | 57 | 1462 |
| 1041561 | N/A | N/A | 441471 | 441490 | CACAACTTCCCCAATCAAAT | 70 | 1463 |
| 1041593 | N/A | N/A | 442076 | 442095 | CTCAAGAGATTATCTCCTAT | 30 | 1464 |
| 1041625 | N/A | N/A | 442399 | 442418 | ACAGGGATAGTGACAAACAC | 24 | 1465 |
| 1041657 | N/A | N/A | 442969 | 442988 | CTGTGAATCACTTTCTCAGG | 73 | 1466 |
| 1041689 | N/A | N/A | 443234 | 443253 | ACCCCTCAAATCCAGTTCAT | 129 | 1467 |
| 1041721 | N/A | N/A | 443723 | 443742 | GTAGACAGCCAGTAAGTACA | 62 | 1468 |
| 1041753 | N/A | N/A | 444096 | 444115 | ACCCACAAACAAAAATGTGG | 132 | 1469 |
| 1041785 | N/A | N/A | 444648 | 444667 | CGCCAATGTGAAAAGGCGAC |  | 1470 |
| 1041817 | N/A | N/A | 445374 | 445393 | AGTGTTCTATTTAAAACACT | 131 | 1471 |
| 1041849 | N/A | N/A | 445708 | 445727 | CCAGACATACAAATTTCGCC | 40 | 1472 |
| 1041881 | N/A | N/A | 445955 | 445974 | AGTCAATAACTACTATATCT | 46 | 1473 |
| 1041913 | N/A | N/A | 446221 | 446240 | CCAGCAAGCCCATGTGCTCA | 109 | 1474 |
| 1041945 | N/A | N/A | 446792 | 446811 | AGTACCACAGATAACCAAAG | 52 | 1475 |
| 1041977 | N/A | N/A | 447180 | 447199 | CTGTATGGAAAAACATTGCA | 29 | 1476 |
| 1042009 | N/A | N/A | 448133 | 448152 | ATGATGATCATTATGTAGAG | 24 | 1477 |
| 1042041 | N/A | N/A | 448619 | 448638 | AATGATACTATTTTTTTACT | 77 | 1478 |
| 1042073 | N/A | N/A | 448923 | 448942 | GGAGACAGAACATACACGCA | 44 | 1479 |
| 1042105 | N/A | N/A | 449439 | 449458 | TCTGTGAATTCCTTGAATTT | 41 | 1480 |
| 1042137 | N/A | N/A | 449765 | 449784 | GGTGAAAGTTAAAATCTTGT | 60 | 1481 |
| 1042169 | N/A | N/A | 450072 | 450091 | TCTTTAATCACTTCAAAGGC | 54 | 1482 |
| 1042201 | N/A | N/A | 450754 | 450773 | GGCTTTCCCAATAAACCTGC | 37 | 1483 |
| 1042233 | N/A | N/A | 451493 | 451512 | GTACTTTTAGAAACTAACTC | 47 | 1484 |
| 1042265 | N/A | N/A | 451798 | 451817 | AAGCCCTTTATAACAGGTAC | 38 | 1485 |
| 1042297 | N/A | N/A | 452094 | 452113 | GCCCAACACCAGGCAGAGGT | 82 | 1486 |
| 1042329 | N/A | N/A | 452407 | 452426 | TTTCAAAACTACATTTACAT | 117 | 1487 |
| 1042361 | N/A | N/A | 452759 | 452778 | TTGTAAATTTTACGAATAGT | 63 | 1488 |

TABLE 20-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1042393 | N/A | N/A | 453673 | 453692 | ACCATCAACAGATCTGCATT | 62 | 1489 |
| 1042425 | N/A | N/A | 454359 | 454378 | GCCTAGCCCCAAACAGGAAA | 117 | 1490 |
| 1042457 | N/A | N/A | 455172 | 455191 | AGGATGCACCAGGGCTTCTC | 79 | 1491 |
| 1042489 | N/A | N/A | 455557 | 455576 | GGGCCTGTTTTCTCCTGAAG | 116 | 1492 |
| 1042521 | N/A | N/A | 456758 | 456777 | GGCTCACAAGCCCAGCGCGG | 132 | 1493 |

TABLE 21

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 3 | 138 |
| 1040090 | 1171 | 1190 | 435890 | 435909 | CTGTTGTAAACCAAGCTCCA | 64 | 1494 |
| 1040122 | 2927 | 2946 | 457180 | 457199 | ATGACCAGCCCTGTCCAAAC | 73 | 1495 |
| 1040154 | 3482 | 3501 | 457735 | 457754 | ACTGTGTTATTTTAGCCTAC | 11 | 1496 |
| 1040186 | 4224 | 4243 | 458477 | 458496 | CCCAACCCCCCTTACCCCAT | 82 | 1497 |
| 1040218 | 4709 | 4728 | 458962 | 458981 | CATTGAAACTTTCAATATCT | 43 | 1498 |
| 1040250 | 4967 | 4986 | 459220 | 459239 | CAGGAATATCACACAAGTTA | 17 | 1499 |
| 1040282 | 5349 | 5368 | 459602 | 459621 | CTATGAAATACCCTTTCTGG | 79 | 1500 |
| 1040314 | 5687 | 5706 | 459940 | 459959 | TTCTAGCTATTCTAAACCTA | 75 | 1501 |
| 1040346 | 6094 | 6113 | 460347 | 460366 | AACCACAAAAATTATGATGA | 59 | 1502 |
| 1040378 | 6872 | 6891 | 461125 | 461144 | CCGAAGAATTTCTACCCCTG | 31 | 1503 |
| 1040410 | 7339 | 7358 | 461592 | 461611 | ATCATCCCAAACTAAACTGG | 71 | 1504 |
| 1040442 | 7739 | 7758 | 461992 | 462011 | TTTTGGCAACATATTTCAGT | 16 | 1505 |
| 1040474 | 8207 | 8226 | 462460 | 462479 | TGTTCTTAAATTCTCTATTT | 18 | 1506 |
| 1040506 | 8508 | 8527 | 462761 | 462780 | GAGTGCTTCAAAATTTTGTT | 20 | 1507 |
| 1040538 | 8843 | 8862 | 463096 | 463115 | CAGTATTCTCAAATCGCAGA | 58 | 1508 |
| 1040570 | 9219 | 9238 | 463472 | 463491 | GGACAGGAATACTATTCTGA | 45 | 1509 |
| 1040602 | 9554 | 9573 | 463807 | 463826 | GGGTGAAGCCTCCAATGTAT | 29 | 1510 |
| 1040634 | 10151 | 10170 | 464404 | 464423 | CCCTCAACCCAAGTTCTGGT | 78 | 1511 |
| 1040666 | 10332 | 10351 | 464585 | 464604 | GCAAGTACAATATTTTACAC | 13 | 1512 |
| 1040698 | N/A | N/A | 6643 | 6662 | CACTGAAAATATATGTTCA | 28 | 1513 |
| 1040730 | N/A | N/A | 23318 | 23337 | CACTATAAAACATCTAACA | 98 | 1514 |
| 1040762 | N/A | N/A | 38292 | 38311 | TTCAACAATATTTATGCCCA | 5 | 1515 |
| 1040794 | N/A | N/A | 63099 | 63118 | CAGCTAAAACCCAACATGG | 109 | 1516 |
| 1040826 | N/A | N/A | 81067 | 81086 | AGTATATATTTTAGCTGAA | 58 | 1517 |
| 1040858 | N/A | N/A | 103630 | 103649 | GCTATATTTTAAAAGGATC | 89 | 1518 |

TABLE 21-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040890 | N/A | N/A | 137052 | 137071 | CTTTCATTTCAAACTTACTG | 59 | 1519 |
| 1040922 | N/A | N/A | 161567 | 161586 | ACTTTCTTTTAAATTCTAAC | 69 | 1520 |
| 1040954 | N/A | N/A | 184602 | 184621 | GATGGTAATTTTTAGAGGTG | 4 | 1521 |
| 1040986 | N/A | N/A | 206522 | 206541 | TCTTTCTATATTTATCTATA | 51 | 1522 |
| 1041018 | N/A | N/A | 223242 | 223261 | GTTTACAAAATATTTGCACA | 37 | 1523 |
| 1041050 | N/A | N/A | 245286 | 245305 | TCTATCAAACCTAATCTATC | 53 | 1524 |
| 1041082 | N/A | N/A | 267260 | 267279 | AAGGAATTTCTTTACACCAT | 27 | 1525 |
| 1041114 | N/A | N/A | 284274 | 284293 | GCACTTCGAATTTATACCAC | 2 | 1526 |
| 1041146 | N/A | N/A | 314135 | 314154 | AACATAAAAATATACCTAA | 109 | 1527 |
| 1041178 | N/A | N/A | 331394 | 331413 | GCTGTTAAAATATGCTTTCC | 2 | 1528 |
| 1041210 | N/A | N/A | 356766 | 356785 | GGGCACTACCCTTATCTTAA | 38 | 1529 |
| 1041242 | N/A | N/A | 376191 | 376210 | CCTGTCAAAAATATAATACC | 89 | 1530 |
| 1041274 | N/A | N/A | 402544 | 402563 | CCTTTAAAAATATGCCTTTT | 46 | 1531 |
| 1041306 | N/A | N/A | 432451 | 432470 | CCAATAAAACCCCACAGGGT | 109 | 1532 |
| 1041338 | N/A | N/A | 438003 | 438022 | CTTTAGCATCTAATCCCCTC | 59 | 1533 |
| 1041370 | N/A | N/A | 438465 | 438484 | AAACCCGTTTACCCTGCCTC | 76 | 1534 |
| 1041402 | N/A | N/A | 439005 | 439024 | GGCCTGACTTTTATATGCAA | 117 | 1535 |
| 1041434 | N/A | N/A | 439383 | 439402 | GTTTTCAAATCCTAGATGGA | 26 | 1536 |
| 1041466 | N/A | N/A | 440010 | 440029 | GGGCCCTTCCAAAGACTGTA | 124 | 1537 |
| 1041498 | N/A | N/A | 440298 | 440317 | ACCTCTTTTCACACCTGCCT | 22 | 1538 |
| 1041530 | N/A | N/A | 440851 | 440870 | CACAGGGAAGCCAATTTCTC | 76 | 1539 |
| 1041562 | N/A | N/A | 441483 | 441502 | CATCTCTTCTTCCACAACTT | 52 | 1540 |
| 1041594 | N/A | N/A | 442078 | 442097 | CTCTCAAGAGATTATCTCCT | 104 | 1541 |
| 1041626 | N/A | N/A | 442489 | 442508 | CTTTCCTCCCACAGCACCTA | 49 | 1542 |
| 1041658 | N/A | N/A | 442983 | 443002 | GATTTATTTTTCAGCTGTGA | 6 | 1543 |
| 1041690 | N/A | N/A | 443237 | 443256 | TGCACCCCTCAAATCCAGTT | 99 | 1544 |
| 1041722 | N/A | N/A | 443729 | 443748 | CCATCGGTAGACAGCCAGTA | 39 | 1545 |
| 1041754 | N/A | N/A | 444105 | 444124 | GGTACAAAGACCCACAAACA | 51 | 1546 |
| 1041786 | N/A | N/A | 444737 | 444756 | AACATAATATTCAGTGCTAA | 40 | 1547 |
| 1041818 | N/A | N/A | 445375 | 445394 | GAGTGTTCTATTTAAAACAC | 82 | 1548 |
| 1041850 | N/A | N/A | 445710 | 445729 | TCCCAGACATACAAATTTCG | 90 | 1549 |
| 1041882 | N/A | N/A | 445956 | 445975 | TAGTCAATAACTACTATATC | 148 | 1550 |
| 1041914 | N/A | N/A | 446222 | 446241 | GCCAGCAAGCCCATGTGCTC | 121 | 1551 |
| 1041946 | N/A | N/A | 446793 | 446812 | CAGTACCACAGATAACCAAA | 30 | 1552 |
| 1041978 | N/A | N/A | 447541 | 447560 | GCTCAGTTAAAATCTGAAAG | 38 | 1553 |
| 1042010 | N/A | N/A | 448228 | 448247 | GTGGGCTCAAGATATCTTCC | 113 | 1554 |

TABLE 21-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1042042 | N/A | N/A | 448621 | 448640 | AGAATGATACTATTTTTTTA | 92 | 1555 |
| 1042074 | N/A | N/A | 448934 | 448953 | GCCTCCCACCAGGAGACAGA | 115 | 1556 |
| 1042106 | N/A | N/A | 449466 | 449485 | GATGTCATCTTCAACTGGAA | 28 | 1557 |
| 1042138 | N/A | N/A | 449771 | 449790 | TTCTTTGGTGAAAGTTAAAA | 91 | 1558 |
| 1042170 | N/A | N/A | 450076 | 450095 | TTCTTCTTTAATCACTTCAA | 35 | 1559 |
| 1042202 | N/A | N/A | 450757 | 450776 | TCTGGCTTTCCCAATAAACC | 62 | 1560 |
| 1042234 | N/A | N/A | 451505 | 451524 | AACAACAATCATGTACTTTT | 36 | 1561 |
| 1042266 | N/A | N/A | 451800 | 451819 | ACAAGCCCTTTATAACAGGT | 16 | 1562 |
| 1042298 | N/A | N/A | 452096 | 452115 | TTGCCCAACACCAGGCAGAG | 104 | 1563 |
| 1042330 | N/A | N/A | 452408 | 452427 | GTTTCAAAACTACATTTACA | 100 | 1564 |
| 1042362 | N/A | N/A | 452769 | 452788 | TCTTCCAATTTTGTAAATTT | 35 | 1565 |
| 1042394 | N/A | N/A | 453674 | 453693 | CACCATCAACAGATCTGCAT | 88 | 1566 |
| 1042426 | N/A | N/A | 454361 | 454380 | AGGCCTAGCCCCAAACAGGA | 145 | 1567 |
| 1042458 | N/A | N/A | 455185 | 455204 | CAGATCTTAAAAAAGGATGC | 59 | 1568 |
| 1042490 | N/A | N/A | 455600 | 455619 | ATCAGGAAAGATGATGGCC | 111 | 1569 |
| 1042522 | N/A | N/A | 456802 | 456821 | AGAGCACCCACTTAGCTTTC | 98 | 1570 |

TABLE 22

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 2 | 138 |
| 1040091 | 1181 | 1200 | 435900 | 435919 | AACCTATTCCCTGTTGTAAA | 23 | 1571 |
| 1040123 | 2969 | 2988 | 457222 | 457241 | ACGGCAAATCAAAGAGCTGG | 130 | 1572 |
| 1040155 | 3517 | 3536 | 457770 | 457789 | ACAGAAACCTAAAATTAAGA | 116 | 1573 |
| 1040187 | 4227 | 4246 | 458480 | 458499 | ACCCCCAACCCCCCTTACCC | 102 | 1574 |
| 1040219 | 4720 | 4739 | 458973 | 458992 | CCTTTAAACCACATTGAAAC | 69 | 1575 |
| 1040251 | 4968 | 4987 | 459221 | 459240 | GCAGGAATATCACACAAGTT | 14 | 1576 |
| 1040283 | 5351 | 5370 | 459604 | 459623 | AACTATGAAATACCCTTTCT | 130 | 1577 |
| 1040315 | 5696 | 5715 | 459949 | 459968 | AAGGAACTATTCTAGCTATT | 43 | 1578 |
| 1040347 | 6097 | 6116 | 460350 | 460369 | TAGAACCACAAAAATTATGA | 65 | 1579 |
| 1040379 | 6873 | 6892 | 461126 | 461145 | ACCGAAGAATTTCTACCCCT | 37 | 1580 |
| 1040411 | 7351 | 7370 | 461604 | 461623 | AACAGAAATCAAATCATCCC | 58 | 1581 |
| 1040443 | 7751 | 7770 | 462004 | 462023 | AACAAAATAAATTTTGGCA | 103 | 1582 |
| 1040475 | 8210 | 8229 | 462463 | 462482 | ATGTGTTCTTAAATTCTCTA | 9 | 1583 |
| 1040507 | 8523 | 8542 | 462776 | 462795 | TGTACTCCTCAAAGTGAGTG | 126 | 1584 |

TABLE 22-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040539 | 8844 | 8863 | 463097 | 463116 | ACAGTATTCTCAAATCGCAG | 67 | 1585 |
| 1040571 | 9251 | 9270 | 463504 | 463523 | CTGTCCAGTTTCCACTGTCC | 31 | 1586 |
| 1040603 | 9584 | 9603 | 463837 | 463856 | CAGCAAACAAACTAAAGGGA | 29 | 1587 |
| 1040635 | 10152 | 10171 | 464405 | 464424 | GCCCTCAACCCAAGTTCTGG | 129 | 1588 |
| 1040667 | 10375 | 10394 | 464628 | 464647 | TATGAATTCTTCCATTTTTT | 92 | 1589 |
| 1040699 | N/A | N/A | 7015 | 7034 | AACATTATTCAAAGAAATGT | 108 | 1590 |
| 1040731 | N/A | N/A | 24365 | 24384 | AGGCAGAACATTTAACATCG | 29 | 1591 |
| 1040763 | N/A | N/A | 38732 | 38751 | TCTGTGTTTATTTAGGTTTC | 3 | 1592 |
| 1040795 | N/A | N/A | 64787 | 64806 | ACTGCATTTCAAAACCTACA | 25 | 1593 |
| 1040827 | N/A | N/A | 81310 | 81329 | TTGAAGTTTTAAAGTACATG | 87 | 1594 |
| 1040859 | N/A | N/A | 105462 | 105481 | ATGTTTAAAATATGCATGCC | 152 | 1595 |
| 1040891 | N/A | N/A | 137270 | 137289 | TTTCTCAGAATATAACTGTA | 44 | 1596 |
| 1040923 | N/A | N/A | 162773 | 162792 | GTGTAATTTCAAAATAGGGT | 10 | 1597 |
| 1040955 | N/A | N/A | 185622 | 185641 | AGCTTTCAAATTTATCCACT | 9 | 1598 |
| 1040987 | N/A | N/A | 207222 | 207241 | ACTTAGCCAATTTAACTGCA | 26 | 1599 |
| 1041019 | N/A | N/A | 224367 | 224386 | TCTTTAAAACTATTAGTCAC | 81 | 1600 |
| 1041051 | N/A | N/A | 245290 | 245309 | CTAATCTATCAAACCTAATC | 142 | 1601 |
| 1041083 | N/A | N/A | 267301 | 267320 | TCAGTTAAAATACCTGATGA | 94 | 1602 |
| 1041115 | N/A | N/A | 284506 | 284525 | GGTTAATATTTTTATGGTAT | 1 | 1603 |
| 1041147 | N/A | N/A | 314443 | 314462 | GTTATAATTTAAAAGTGTT | 100 | 1604 |
| 1041179 | N/A | N/A | 332631 | 332650 | CCGTTTTATTTTTAAACTCG | 9 | 1605 |
| 1041211 | N/A | N/A | 356791 | 356810 | GCTTCATTTTAAAAGATTGT | 7 | 1606 |
| 1041243 | N/A | N/A | 376226 | 376245 | CCACATAAAATATCGAATCA | 40 | 1607 |
| 1041275 | N/A | N/A | 407589 | 407608 | CAGGGCTGTATTTAATTCTG | 14 | 1608 |
| 1041307 | N/A | N/A | 433208 | 433227 | GTTCTCAATCCTTAATGATT | 55 | 1609 |
| 1041339 | N/A | N/A | 438044 | 438063 | GACATATTTTAAAACATGGA | 13 | 1610 |
| 1041371 | N/A | N/A | 438475 | 438494 | AACCAATCCTAAACCCGTTT | 62 | 1611 |
| 1041403 | N/A | N/A | 439006 | 439025 | AGGCCTGACTTTTATATGCA | 137 | 1612 |
| 1041435 | N/A | N/A | 439384 | 439403 | TGTTTTCAAATCCTAGATGG | 43 | 1613 |
| 1041467 | N/A | N/A | 440042 | 440061 | TTTTAAATAAGATCTTTGGG | 62 | 1614 |
| 1041499 | N/A | N/A | 440299 | 440318 | AACCTCTTTTCACACCTGCC | 26 | 1615 |
| 1041531 | N/A | N/A | 440909 | 440928 | AGTAGAGAGATTTAGTGATC | 16 | 1616 |
| 1041563 | N/A | N/A | 441492 | 441511 | GGAGAAAACCATCTCTTCTT | 76 | 1617 |
| 1041595 | N/A | N/A | 442096 | 442115 | GCATTAAAAACGGAACCCT | 103 | 1618 |
| 1041627 | N/A | N/A | 442494 | 442513 | TTCCCCTTTCCTCCCACAGC | 99 | 1619 |
| 1041659 | N/A | N/A | 442984 | 443003 | TGATTTATTTTCAGCTGTG | 5 | 1620 |

TABLE 22-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041691 | N/A | N/A | 443239 | 443258 | AATGCACCCCTCAAATCCAG | 109 | 1621 |
| 1041723 | N/A | N/A | 443762 | 443781 | AGTCAACCAAAAAATAGTAG | 40 | 1622 |
| 1041755 | N/A | N/A | 444110 | 444129 | AGAGAGGTACAAAGACCCAC | 52 | 1623 |
| 1041787 | N/A | N/A | 444740 | 444759 | AACAACATAATATTCAGTGC | 27 | 1624 |
| 1041819 | N/A | N/A | 445394 | 445413 | TGAGTGTAAGAATCTCTGTG | 119 | 1625 |
| 1041851 | N/A | N/A | 445716 | 445735 | ACACTATCCCAGACATACAA | 57 | 1626 |
| 1041883 | N/A | N/A | 445961 | 445980 | CCACTTAGTCAATAACTACT | 34 | 1627 |
| 1041915 | N/A | N/A | 446223 | 446242 | TGCCAGCAAGCCCATGTGCT | 98 | 1628 |
| 1041947 | N/A | N/A | 446796 | 446815 | GAGCAGTACCACAGATAACC | 22 | 1629 |
| 1041979 | N/A | N/A | 447542 | 447561 | TGCTCAGTTAAAATCTGAAA | 49 | 1630 |
| 1042011 | N/A | N/A | 448333 | 448352 | CTCTAGTTTCCATAGCTTCC | 42 | 1631 |
| 1042043 | N/A | N/A | 448635 | 448654 | TTCCAAATACACCTAGAATG | 68 | 1632 |
| 1042075 | N/A | N/A | 448937 | 448956 | CTTGCCTCCCACCAGGAGAC | 100 | 1633 |
| 1042107 | N/A | N/A | 449467 | 449486 | TGATGTCATCTTCAACTGGA | 27 | 1634 |
| 1042139 | N/A | N/A | 449783 | 449802 | GGTTTTTTCCCTTCTTTGG | 8 | 1635 |
| 1042171 | N/A | N/A | 450078 | 450097 | GATTCTTCTTTAATCACTTC | 31 | 1636 |
| 1042203 | N/A | N/A | 450777 | 450796 | CTCATCATCTTCTCAATTTC | 86 | 1637 |
| 1042235 | N/A | N/A | 451509 | 451528 | CACAAACAACAATCATGTAC | 47 | 1638 |
| 1042267 | N/A | N/A | 451802 | 451821 | CTACAAGCCCTTTATAACAG | 26 | 1639 |
| 1042299 | N/A | N/A | 452101 | 452120 | TATTCTTGCCCAACACCAGG | 80 | 1640 |
| 1042331 | N/A | N/A | 452409 | 452428 | GGTTTCAAAACTACATTTAC | 58 | 1641 |
| 1042363 | N/A | N/A | 452840 | 452859 | TCTCAGGTACAAACTTTACA | 26 | 1642 |
| 1042395 | N/A | N/A | 453676 | 453695 | TTCACCATCAACAGATCTGC | 80 | 1643 |
| 1042427 | N/A | N/A | 454375 | 454394 | AGACAGTTTCAAGAAGGCCT | 111 | 1644 |
| 1042459 | N/A | N/A | 455186 | 455205 | TCAGATCTTAAAAAAGGATG | 102 | 1645 |
| 1042491 | N/A | N/A | 456123 | 456142 | AAGATAGTAAAAAGGCCAGG | 135 | 1646 |
| 1042523 | N/A | N/A | 456821 | 456840 | ATCGAACCCCAGTAATGACA | 38 | 1647 |

TABLE 23

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 3 | 138 |
| 1040092 | 1188 | 1207 | 435907 | 435926 | TTGTGTAAACCTATTCCCTG | 17 | 1648 |
| 1040124 | 2971 | 2990 | 457224 | 457243 | ACACGGCAAATCAAAGAGCT | 93 | 1649 |
| 1040156 | 3526 | 3545 | 457779 | 457798 | AAGGTTAGAACAGAAACCTA | 94 | 1650 |

TABLE 23-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040188 | 4228 | 4247 | 458481 | 458500 | CACCCCCAACCCCCCTTACC | 112 | 1651 |
| 1040220 | 4721 | 4740 | 458974 | 458993 | CCCTTTAAACCACATTGAAA | 59 | 1652 |
| 1040252 | 5005 | 5024 | 459258 | 459277 | CCCCAAACCTTTCCCACAAT | 53 | 1653 |
| 1040284 | 5387 | 5406 | 459640 | 459659 | ATGATATTTCGGATCTCTGG | 11 | 1654 |
| 1040316 | 5699 | 5718 | 459952 | 459971 | GTCAAGGAACTATTCTAGCT | 22 | 1655 |
| 1040348 | 6113 | 6132 | 460366 | 460385 | ATTCCTATACCTGAAATAGA | 51 | 1656 |
| 1040380 | 6874 | 6893 | 461127 | 461146 | CACCGAAGAATTTCTACCCC | 54 | 1657 |
| 1040412 | 7385 | 7404 | 461638 | 461657 | CTCACAATTCCAAGTTAGAA | 23 | 1658 |
| 1040444 | 7827 | 7846 | 462080 | 462099 | AGTAGTCACAGATGTTAAAG | 16 | 1659 |
| 1040476 | 8211 | 8230 | 462464 | 462483 | GATGTGTTCTTAAATTCTCT | 14 | 1660 |
| 1040508 | 8526 | 8545 | 462779 | 462798 | ACCTGTACTCCTCAAAGTGA | 58 | 1661 |
| 1040540 | 8845 | 8864 | 463098 | 463117 | AACAGTATTCTCAAATCGCA | 73 | 1662 |
| 1040572 | 9267 | 9286 | 463520 | 463539 | CTTAATATCCCCACAGCTGT | 108 | 1663 |
| 1040604 | 9597 | 9616 | 463850 | 463869 | TTGGCCATCCAGACAGCAAA | 96 | 1664 |
| 1040636 | 10153 | 10172 | 464406 | 464425 | TGCCCTCAACCCAAGTTCTG | 82 | 1665 |
| 1040668 | 10376 | 10395 | 464629 | 464648 | ATATGAATTCTTCCATTTTT | 91 | 1666 |
| 1040700 | N/A | N/A | 7886 | 7905 | CGTTATAAAATATATTACTA | 97 | 1667 |
| 1040732 | N/A | N/A | 24555 | 24574 | GCAAGATGAATTTATCCTCC | 11 | 1668 |
| 1040764 | N/A | N/A | 38983 | 39002 | CACAACTTATTTTAATGTCA | 13 | 1669 |
| 1040796 | N/A | N/A | 66238 | 66257 | TGAGTATTTTAAACTCTTCT | 138 | 1670 |
| 1040828 | N/A | N/A | 83133 | 83152 | ATTCCATTATTTTAGAAAGC | 50 | 1671 |
| 1040860 | N/A | N/A | 105795 | 105814 | ACTTGCAAAATTTCAAGTTT | 131 | 1672 |
| 1040892 | N/A | N/A | 138729 | 138748 | AGCAAGTTAATTTATGGCCA | 101 | 1673 |
| 1040924 | N/A | N/A | 163155 | 163174 | GATTGAATCATTTACCTCGC | 49 | 1674 |
| 1040956 | N/A | N/A | 185759 | 185778 | ATCTGCTTTCTTTATTCCCT | 9 | 1675 |
| 1040988 | N/A | N/A | 207251 | 207270 | ATCTCTGTTATTTAACACTG | 70 | 1676 |
| 1041020 | N/A | N/A | 224368 | 224387 | TTCTTTAAAACTATTAGTCA | 122 | 1677 |
| 1041052 | N/A | N/A | 245320 | 245339 | GACCTCAAAACCAAATTAGG | 119 | 1678 |
| 1041084 | N/A | N/A | 268039 | 268058 | TCTGAAATTCAAAATCAGTG | 122 | 1679 |
| 1041116 | N/A | N/A | 284543 | 284562 | CCACTGGAAATTTAACATGA | 18 | 1680 |
| 1041148 | N/A | N/A | 315438 | 315457 | TGTATCACCCATTAACTGAC | 2 | 1681 |
| 1041180 | N/A | N/A | 332732 | 332751 | GACTAAAAATATACATCTC | 57 | 1682 |
| 1041212 | N/A | N/A | 356967 | 356986 | GGTCTATTCTTTACAGCAC | 2 | 1683 |
| 1041244 | N/A | N/A | 376250 | 376269 | TTCTTCTGTATTTAATTCTT | 18 | 1684 |
| 1041276 | N/A | N/A | 407619 | 407638 | ACTGAGTTTCAAAGCAAAGA | 30 | 1685 |
| 1041308 | N/A | N/A | 433762 | 433781 | ATCCGATTTTAAAACAAACA | 64 | 1686 |

TABLE 23-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041340 | N/A | N/A | 438045 | 438064 | AGACATATTTTAAAACATGG | 29 | 1687 |
| 1041372 | N/A | N/A | 438476 | 438495 | TAACCAATCCTAAACCCGTT | 97 | 1688 |
| 1041404 | N/A | N/A | 439022 | 439041 | ATTAGCTAATTCCTAGAGGC | 60 | 1689 |
| 1041436 | N/A | N/A | 439388 | 439407 | TGAATGTTTTCAAATCCTAG | 31 | 1690 |
| 1041468 | N/A | N/A | 440075 | 440094 | CCATTTATTTTAAAAATCCT | 69 | 1691 |
| 1041500 | N/A | N/A | 440312 | 440331 | CATTTCTAAACAAAACCTCT | 95 | 1692 |
| 1041532 | N/A | N/A | 440910 | 440929 | CAGTAGAGAGATTTAGTGAT | 15 | 1693 |
| 1041564 | N/A | N/A | 441493 | 441512 | TGGAGAAAACCATCTCTTCT | 126 | 1694 |
| 1041596 | N/A | N/A | 442101 | 442120 | GTGAAGCATTAAAAACGGA | 28 | 1695 |
| 1041628 | N/A | N/A | 442500 | 442519 | CTGGCATTCCCCTTTCCTCC | 92 | 1696 |
| 1041660 | N/A | N/A | 442985 | 443004 | TTGATTTATTTTTCAGCTGT | 30 | 1697 |
| 1041692 | N/A | N/A | 443241 | 443260 | CCAATGCACCCCTCAAATCC | 147 | 1698 |
| 1041724 | N/A | N/A | 443784 | 443803 | CCGATGACTCACAGCTCACA | 46 | 1699 |
| 1041756 | N/A | N/A | 444141 | 444160 | GAGAGCATTTTCTCCTTTT | 25 | 1700 |
| 1041788 | N/A | N/A | 444741 | 444760 | GAACAACATAATATTCAGTG | 10 | 1701 |
| 1041820 | N/A | N/A | 445425 | 445444 | TCATTAATAAAAACAGTCAA | 102 | 1702 |
| 1041852 | N/A | N/A | 445718 | 445737 | TGACACTATCCCAGACATAC | 34 | 1703 |
| 1041884 | N/A | N/A | 445963 | 445982 | CACCACTTAGTCAATAACTA | 38 | 1704 |
| 1041916 | N/A | N/A | 446261 | 446280 | CCACCCTCCTCCACTCTTTC | 138 | 1705 |
| 1041948 | N/A | N/A | 446798 | 446817 | GGGAGCAGTACCACAGATAA | 34 | 1706 |
| 1041980 | N/A | N/A | 447543 | 447562 | GTGCTCAGTTAAAATCTGAA | 29 | 1707 |
| 1042012 | N/A | N/A | 448335 | 448354 | CCCTCTAGTTTCCATAGCTT | 60 | 1708 |
| 1042044 | N/A | N/A | 448638 | 448657 | CTTTTCCAAATACACCTAGA | 46 | 1709 |
| 1042076 | N/A | N/A | 448955 | 448974 | TTGGTTAAGACCTAGTTTCT | 52 | 1710 |
| 1042108 | N/A | N/A | 449502 | 449521 | TGGATGTGAAACAGAGACGG | 17 | 1711 |
| 1042140 | N/A | N/A | 449787 | 449806 | ATAAGGTTTTTTCCCTTCT | 48 | 1712 |
| 1042172 | N/A | N/A | 450079 | 450098 | AGATTCTTCTTTAATCACTT | 39 | 1713 |
| 1042204 | N/A | N/A | 450800 | 450819 | GAGATGGTACTTTAGAAGGC | 14 | 1714 |
| 1042236 | N/A | N/A | 451510 | 451529 | ACACAAACAACAATCATGTA | 56 | 1715 |
| 1042268 | N/A | N/A | 451805 | 451824 | TGTCTACAAGCCCTTTATAA | 50 | 1716 |
| 1042300 | N/A | N/A | 452105 | 452124 | TGCTTATTCTTGCCCAACAC | 35 | 1717 |
| 1042332 | N/A | N/A | 452410 | 452429 | TGGTTTCAAAACTACATTTA | 105 | 1718 |
| 1042364 | N/A | N/A | 452899 | 452918 | GGCTATTTTTATAATGTGAA | 25 | 1719 |
| 1042396 | N/A | N/A | 453692 | 453711 | ACAGTAATTAAAAGAATTCA | 88 | 1720 |
| 1042428 | N/A | N/A | 454436 | 454455 | CAGAAGTTAATACTTGAGGA | 71 | 1721 |
| 1042460 | N/A | N/A | 455194 | 455213 | GCAAAATATCAGATCTTAAA | 65 | 1722 |

TABLE 23-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1042492 | N/A | N/A | 456134 | 456153 | GGACAGCAAATAAGATAGTA | 48 | 1723 |
| 1042524 | N/A | N/A | 456828 | 456847 | CCAGTCAATCGAACCCCAGT | 85 | 1724 |

TABLE 24

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 1 | 138 |
| 1040093 | 1189 | 1208 | 435908 | 435927 | TTTGTGTAAACCTATTCCCT | 23 | 1725 |
| 1040125 | 2998 | 3017 | 457251 | 457270 | GCAGACATCCCCAACTGAGA | 41 | 1726 |
| 1040157 | 3559 | 3578 | 457812 | 457831 | CTCCTGCGACACACCTGCTG | 58 | 1727 |
| 1040189 | 4287 | 4306 | 458540 | 458559 | ATTGGTTTTCCTAACACTGC | 54 | 1728 |
| 1040221 | 4722 | 4741 | 458975 | 458994 | TCCCTTTAAACCACATTGAA | 65 | 1729 |
| 1040253 | 5006 | 5025 | 459259 | 459278 | CCCCCAAACCTTTCCCACAA | 61 | 1730 |
| 1040285 | 5394 | 5413 | 459647 | 459666 | CCCACAAATGATATTTCGGA | 20 | 1731 |
| 1040317 | 5719 | 5738 | 459972 | 459991 | GGTAATGAAATTCGAGGAAA | 12 | 1732 |
| 1040349 | 6120 | 6139 | 460373 | 460392 | TTTTATAATTCCTATACCTG | 61 | 1733 |
| 1040381 | 6876 | 6895 | 461129 | 461148 | GGCACCGAAGAATTTCTACC | 28 | 1734 |
| 1040413 | 7386 | 7405 | 461639 | 461658 | GCTCACAATTCCAAGTTAGA | 17 | 1735 |
| 1040445 | 7830 | 7849 | 462083 | 462102 | CTTAGTAGTCACAGATGTTA | 27 | 1736 |
| 1040477 | 8225 | 8244 | 462478 | 462497 | TATATTTATTACTTGATGTG | 24 | 1737 |
| 1040509 | 8541 | 8560 | 462794 | 462813 | ATTTTTTAAAACATTACCTG | 112 | 1738 |
| 1040541 | 8869 | 8888 | 463122 | 463141 | AGAAGTACTTTCAGCATAGG | 12 | 1739 |
| 1040573 | 9268 | 9287 | 463521 | 463540 | GCTTAATATCCCCACAGCTG | 120 | 1740 |
| 1040605 | 9624 | 9643 | 463877 | 463896 | TTGGCCACAGAAAAGGAGAC | 110 | 1741 |
| 1040637 | 10159 | 10178 | 464412 | 464431 | TGGTAGTGCCCTCAACCCAA | 43 | 1742 |
| 1040669 | 10394 | 10413 | 464647 | 464666 | CCACGATTAGAAAATAGAAT | 108 | 1743 |
| 1040701 | N/A | N/A | 8020 | 8039 | TCAAACAAAATATAATGCTT | 87 | 1744 |
| 1040733 | N/A | N/A | 24636 | 24655 | CTACACAAAACCAATCACTT | 78 | 1745 |
| 1040765 | N/A | N/A | 39292 | 39311 | CGCCTTAATTTTTATTATAG | 83 | 1746 |
| 1040797 | N/A | N/A | 66579 | 66598 | CCATTTAGAATATAGCTGTT | 25 | 1747 |
| 1040829 | N/A | N/A | 83570 | 83589 | ATTCTCATCCATTATACTTT | 48 | 1748 |
| 1040861 | N/A | N/A | 106210 | 106229 | TTACCAAAAACCATTTGTGT | 21 | 1749 |
| 1040893 | N/A | N/A | 138831 | 138850 | TCCTTCTTTCAAAGTTCACC | 26 | 1750 |
| 1040925 | N/A | N/A | 163322 | 163341 | CTGCCACTATTTTATGTCTG | 59 | 1751 |

TABLE 24 -continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040957 | N/A | N/A | 185775 | 185794 | CCCAGGTTCCCTTATCATCT | 19 | 1752 |
| 1040989 | N/A | N/A | 207430 | 207449 | TTCTGCAAATAATTCCGTCA | 23 | 1753 |
| 1041021 | N/A | N/A | 224375 | 224394 | CCATCATTTCTTTAAAACTA | 67 | 1754 |
| 1041053 | N/A | N/A | 246302 | 246321 | AAGTACATACAAATACATAT | 146 | 1755 |
| 1041085 | N/A | N/A | 268505 | 268524 | CCTATCAAAGCCACAACTTC | 117 | 1756 |
| 1041117 | N/A | N/A | 284846 | 284865 | TTGTATACCATTTATGTTTC | 2 | 1757 |
| 1041149 | N/A | N/A | 315942 | 315961 | CCACTCAAACCTTTCAATGC | 20 | 1758 |
| 1041181 | N/A | N/A | 334092 | 334111 | GAGCTCAAACCCAAGTCTGT | 72 | 1759 |
| 1041213 | N/A | N/A | 357527 | 357546 | ACCCTATTTCCTTAATGTAA | 41 | 1760 |
| 1041245 | N/A | N/A | 377993 | 378012 | CTCCTTCACCCTTAAGGCTA | 68 | 1761 |
| 1041277 | N/A | N/A | 409360 | 409379 | ATCGAGTCCTTTTAAACAAA | 19 | 1762 |
| 1041309 | N/A | N/A | 434288 | 434307 | ACAACTCGCCATTAACACTA | 65 | 1763 |
| 1041341 | N/A | N/A | 438053 | 438072 | AGCTAATAAGACATATTTTA | 109 | 1764 |
| 1041373 | N/A | N/A | 438477 | 438496 | CTAACCAATCCTAAACCCGT | 101 | 1765 |
| 1041405 | N/A | N/A | 439023 | 439042 | GATTAGCTAATTCCTAGAGG | 42 | 1766 |
| 1041437 | N/A | N/A | 439389 | 439408 | TTGAATGTTTTCAAATCCTA | 41 | 1767 |
| 1041469 | N/A | N/A | 440076 | 440095 | GCCATTTATTTTAAAAATCC | 10 | 1768 |
| 1041501 | N/A | N/A | 440313 | 440332 | GCATTTCTAAACAAAACCTC | 62 | 1769 |
| 1041533 | N/A | N/A | 441017 | 441036 | TGAGGAAGCCCTTCCCGGCA | 115 | 1770 |
| 1041565 | N/A | N/A | 441494 | 441513 | TTGGAGAAAACCATCTCTTC | 108 | 1771 |
| 1041597 | N/A | N/A | 442114 | 442133 | GGAAAGTATAAAAGTGAAGC | 25 | 1772 |
| 1041629 | N/A | N/A | 442524 | 442543 | GCACGCAGTAACAATGGACA | 31 | 1773 |
| 1041661 | N/A | N/A | 442987 | 443006 | CTTTGATTATTTTTCAGCT | 11 | 1774 |
| 1041693 | N/A | N/A | 443288 | 443307 | CCCTTGTTTCTGCATTGGTT | 46 | 1775 |
| 1041725 | N/A | N/A | 443792 | 443811 | TGTTACCACCGATGACTCAC | 42 | 1776 |
| 1041757 | N/A | N/A | 444158 | 444177 | GCACATACAGTTTAAAGGAG | 12 | 1777 |
| 1041789 | N/A | N/A | 444885 | 444904 | GGTCCCTGTTCCTAGGGAGG | 143 | 1778 |
| 1041821 | N/A | N/A | 445439 | 445458 | GCAATGTTTAAAAATCATTA | 71 | 1779 |
| 1041853 | N/A | N/A | 445722 | 445741 | TTCATGACACTATCCCAGAC | 46 | 1780 |
| 1041885 | N/A | N/A | 445968 | 445987 | CCTTTCACCACTTAGTCAAT | 33 | 1781 |
| 1041917 | N/A | N/A | 446266 | 446285 | GCCTCCCACCCTCCTCCACT | 101 | 1782 |
| 1041949 | N/A | N/A | 446814 | 446833 | ATGAAAATAAACTCATGGGA | 84 | 1783 |
| 1041981 | N/A | N/A | 447571 | 447590 | GTCTAAAGACTTCCTAGCA | 78 | 1784 |
| 1042013 | N/A | N/A | 448352 | 448371 | TCTATTTAAAATAACAACCC | 107 | 1785 |
| 1042045 | N/A | N/A | 448641 | 448660 | TTCCTTTTCCAAATACACCT | 59 | 1786 |
| 1042077 | N/A | N/A | 448969 | 448988 | TAGAAGAGTATCTATTGGTT | 32 | 1787 |
| 1042109 | N/A | N/A | 449541 | 449560 | CATCTCAAAACATGCTGTCA | 86 | 1788 |

TABLE 24 -continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1042141 | N/A | N/A | 449797 | 449816 | GAGAAGTAAAATAAGGTTTT | 62 | 1789 |
| 1042173 | N/A | N/A | 450080 | 450099 | GAGATTCTTCTTTAATCACT | 27 | 1790 |
| 1042205 | N/A | N/A | 451120 | 451139 | GGAGATTTTACTTAATTTTT | 8 | 1791 |
| 1042237 | N/A | N/A | 451511 | 451530 | TACACAAACAACAATCATGT | 54 | 1792 |
| 1042269 | N/A | N/A | 451817 | 451836 | CTCATTAAGAAATGTCTACA | 69 | 1793 |
| 1042301 | N/A | N/A | 452128 | 452147 | GACTCTCTACCAGAGTTGCG | 102 | 1794 |
| 1042333 | N/A | N/A | 452413 | 452432 | ATTTGGTTTCAAAACTACAT | 91 | 1795 |
| 1042365 | N/A | N/A | 452900 | 452919 | GGGCTATTTTTATAATGTGA | 20 | 1796 |
| 1042397 | N/A | N/A | 453702 | 453721 | GTTCAGACAAACAGTAATTA | 18 | 1797 |
| 1042429 | N/A | N/A | 454481 | 454500 | ACATAATTTGAATCCTAGGA | 135 | 1798 |
| 1042461 | N/A | N/A | 455196 | 455215 | TAGCAAAATATCAGATCTTA | 41 | 1799 |
| 1042493 | N/A | N/A | 456136 | 456155 | CTGGACAGCAAATAAGATAG | 35 | 1800 |
| 1042525 | N/A | N/A | 456836 | 456855 | TGTTAGAACCAGTCAATCGA | 116 | 1801 |

TABLE 25

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 2 | 138 |
| 1040094 | 1212 | 1231 | 435931 | 435950 | TAGTCCAGCCCTGTGGACAA | 47 | 1802 |
| 1040126 | 2999 | 3018 | 457252 | 457271 | TGCAGACATCCCCAACTGAG | 57 | 1803 |
| 1040158 | 3572 | 3591 | 457825 | 457844 | CATATGCACCAGTCTCCTGC | 65 | 1804 |
| 1040190 | 4299 | 4318 | 458552 | 458571 | TGCAATAACCTGATTGGTTT | 39 | 1805 |
| 1040222 | 4725 | 4744 | 458978 | 458997 | TCATCCCTTTAAACCACATT | 35 | 1806 |
| 1040254 | 5007 | 5026 | 459260 | 459279 | TCCCCCAAACCTTTCCCACA | 94 | 1807 |
| 1040286 | 5401 | 5420 | 459654 | 459673 | TTCAAAACCCACAAATGATA | 88 | 1808 |
| 1040318 | 5721 | 5740 | 459974 | 459993 | AGGGTAATGAAATTCGAGGA | 10 | 1809 |
| 1040350 | 6122 | 6141 | 460375 | 460394 | TATTTTATAATTCCTATACC | 108 | 1810 |
| 1040382 | 6919 | 6938 | 461172 | 461191 | GGACATAGTACAGAGGCACA | 8 | 1811 |
| 1040414 | 7387 | 7406 | 461640 | 461659 | GGCTCACAATTCCAAGTTAG | 32 | 1812 |
| 1040446 | 7840 | 7859 | 462093 | 462112 | AATAGGTTTCCTTAGTAGTC | 22 | 1813 |
| 1040478 | 8227 | 8246 | 462480 | 462499 | TGTATATTATTACTTGATG | 10 | 1814 |
| 1040510 | 8546 | 8565 | 462799 | 462818 | GTGCAATTTTTAAAACATT | 18 | 1815 |
| 1040542 | 8907 | 8926 | 463160 | 463179 | GCAATGGCTTAAGAGTTTAG | 9 | 1816 |
| 1040574 | 9269 | 9288 | 463522 | 463541 | TGCTTAATATCCCCACAGCT | 91 | 1817 |

TABLE 25-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040606 | 9636 | 9655 | 463889 | 463908 | AAGGCCTTCAGATTGGCCAC | 125 | 1818 |
| 1040638 | 10161 | 10180 | 464414 | 464433 | TCTGGTAGTGCCCTCAACCC | 45 | 1819 |
| 1040670 | 10402 | 10421 | 464655 | 464674 | TAGACACACCACGATTAGAA | 68 | 1820 |
| 1040702 | N/A | N/A | 8570 | 8589 | ACTCAATATTTTAAAACCC | 28 | 1821 |
| 1040734 | N/A | N/A | 25367 | 25386 | GACTGAATTATTTATAGTTG | 42 | 1822 |
| 1040766 | N/A | N/A | 40104 | 40123 | ATGCAATTTTAAATTCATGT | 18 | 1823 |
| 1040798 | N/A | N/A | 66787 | 66806 | GGGAAAATTCCTTAGCATAT | 30 | 1824 |
| 1040830 | N/A | N/A | 83587 | 83606 | GCTGAGTTCCAAAGCAAATT | 35 | 1825 |
| 1040862 | N/A | N/A | 106215 | 106234 | ATGACTTACCAAAAACCATT | 105 | 1826 |
| 1040894 | N/A | N/A | 139215 | 139234 | AGGGCTTAAATTTAACTGAA | 28 | 1827 |
| 1040926 | N/A | N/A | 163369 | 163388 | AACGAAATTCCTTAAGGACA | 62 | 1828 |
| 1040958 | N/A | N/A | 185909 | 185928 | TTGGTTCTATTTTATAATAG | 66 | 1829 |
| 1040990 | N/A | N/A | 207479 | 207498 | AGACTACTATTTTATCACTG | 19 | 1830 |
| 1041022 | N/A | N/A | 225966 | 225985 | TCACTTAAACCCAGGTCAGC | 81 | 1831 |
| 1041054 | N/A | N/A | 247054 | 247073 | TTCCCCAAAATTTAGTTGTG | 85 | 1832 |
| 1041086 | N/A | N/A | 268668 | 268687 | CTTCAACTATTTTATTTGGC | 30 | 1833 |
| 1041118 | N/A | N/A | 284950 | 284969 | AGTAGAATTTAAAAGTAGAA | 110 | 1834 |
| 1041150 | N/A | N/A | 316219 | 316238 | GGATTTCTAATTTAATCTTT | 37 | 1835 |
| 1041182 | N/A | N/A | 334729 | 334748 | TAGTTCTTTCAAACTCCTTT | 2 | 1836 |
| 1041214 | N/A | N/A | 358497 | 358516 | GCTATAATTCAAAATGCTCT | 115 | 1837 |
| 1041246 | N/A | N/A | 380363 | 380382 | GCCTAAACAATTTATTCATT | 31 | 1838 |
| 1041278 | N/A | N/A | 409434 | 409453 | ACCCTTCTATTTTATAAAGC | 69 | 1839 |
| 1041310 | N/A | N/A | 434517 | 434536 | TGCAAGTTTCAAAAGAATTC | 133 | 1840 |
| 1041342 | N/A | N/A | 438074 | 438093 | AAGGCATATACCACTGTACC | 61 | 1841 |
| 1041374 | N/A | N/A | 438478 | 438497 | TCTAACCAATCCTAAACCCG | 107 | 1842 |
| 1041406 | N/A | N/A | 439043 | 439062 | AGAGGTATAGTCTCTCCTAG | 29 | 1843 |
| 1041438 | N/A | N/A | 439430 | 439449 | TGACTATTTTCAACTCAAGC | 16 | 1844 |
| 1041470 | N/A | N/A | 440085 | 440104 | TATTATTATGCCATTTATTT | 41 | 1845 |
| 1041502 | N/A | N/A | 440315 | 440334 | TCGCATTTCTAAACAAAACC | 52 | 1846 |
| 1041534 | N/A | N/A | 441019 | 441038 | TTTGAGGAAGCCCTTCCCGG | 119 | 1847 |
| 1041566 | N/A | N/A | 441497 | 441516 | GTTTTGGAGAAAACCATCTC | 69 | 1848 |
| 1041598 | N/A | N/A | 442146 | 442165 | CTAATAAATTTTTACAAGGG | 72 | 1849 |
| 1041630 | N/A | N/A | 442542 | 442561 | AAGGAGGCTTCCTTTGGTGC | 70 | 1850 |
| 1041662 | N/A | N/A | 442991 | 443010 | AGGCCTTTGATTTATTTTTC | 110 | 1851 |
| 1041694 | N/A | N/A | 443385 | 443404 | GATGGAAGCCAAAGGCTCCC | 115 | 1852 |
| 1041726 | N/A | N/A | 443794 | 443813 | AATGTTACCACCGATGACTC | 71 | 1853 |
| 1041758 | N/A | N/A | 444206 | 444225 | TCTGAGAGAATCAAAACATA | 29 | 1854 |

TABLE 25-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041790 | N/A | N/A | 445090 | 445109 | CTCACTTGCCTTCCTTTTCT | 46 | 1855 |
| 1041822 | N/A | N/A | 445440 | 445459 | TGCAATGTTTAAAAATCATT | 94 | 1856 |
| 1041854 | N/A | N/A | 445730 | 445749 | AACATTTTTTCATGACACTA | 10 | 1857 |
| 1041886 | N/A | N/A | 445969 | 445988 | TCCTTTCACCACTTAGTCAA | 47 | 1858 |
| 1041918 | N/A | N/A | 446324 | 446343 | TCTGTCTTTCATCTCTGGAT | 44 | 1859 |
| 1041950 | N/A | N/A | 446817 | 446836 | CCAATGAAAATAAACTCATG | 98 | 1860 |
| 1041982 | N/A | N/A | 447576 | 447595 | CCAGAGTCTAAAAGACTTCC | 110 | 1861 |
| 1042014 | N/A | N/A | 448353 | 448372 | TTCTATTTAAAATAACAACC | 116 | 1862 |
| 1042046 | N/A | N/A | 448648 | 448667 | GTATGGGTTCCTTTTCCAAA | 7 | 1863 |
| 1042078 | N/A | N/A | 449026 | 449045 | AGTTTTAATAAAAGTTCAAC | 96 | 1864 |
| 1042110 | N/A | N/A | 449542 | 449561 | CCATCTCAAAACATGCTGTC | 78 | 1865 |
| 1042142 | N/A | N/A | 449830 | 449849 | ATGTACTTTTTCCCCCTTGG | 65 | 1866 |
| 1042174 | N/A | N/A | 450083 | 450102 | TGGGAGATTCTTCTTTAATC | 19 | 1867 |
| 1042206 | N/A | N/A | 451121 | 451140 | TGGAGATTTTACTTAATTTT | 33 | 1868 |
| 1042238 | N/A | N/A | 451518 | 451537 | GATAATATACACAAACAACA | 86 | 1869 |
| 1042270 | N/A | N/A | 451821 | 451840 | TAGACTCATTAAGAAATGTC | 91 | 1870 |
| 1042302 | N/A | N/A | 452129 | 452148 | AGACTCTCTACCAGAGTTGC | 100 | 1871 |
| 1042334 | N/A | N/A | 452424 | 452443 | TGTGTGACACTATTTGGTTT | 74 | 1872 |
| 1042366 | N/A | N/A | 452902 | 452921 | CTGGGCTATTTTTATAATGT | 30 | 1873 |
| 1042398 | N/A | N/A | 453708 | 453727 | AGACATGTTCAGACAAACAG | 58 | 1874 |
| 1042430 | N/A | N/A | 454483 | 454502 | ACACATAATTTGAATCCTAG | 110 | 1875 |
| 1042462 | N/A | N/A | 455198 | 455217 | ACTAGCAAAATATCAGATCT | 49 | 1876 |
| 1042494 | N/A | N/A | 456154 | 456173 | ACTTTTTTCTTATAGTACT | 68 | 1877 |
| 1042526 | N/A | N/A | 456838 | 456857 | TCTGTTAGAACCAGTCAATC | 51 | 1878 |

TABLE 26

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 2 | 138 |
| 1040095 | 1514 | 1533 | 436233 | 436252 | TCAGACTGCCCATGTTGGCC | 71 | 1879 |
| 1040127 | 3033 | 3052 | 457286 | 457305 | GAGCCGTTCTTCAGGTTCTT | 93 | 1880 |
| 1040159 | 3643 | 3662 | 457896 | 457915 | GCCTGGAGCCCTGACCGCTC | 60 | 1881 |
| 1040191 | 4300 | 4319 | 458553 | 458572 | ATGCAATAACCTGATTGGTT | 16 | 1882 |
| 1040223 | 4727 | 4746 | 458980 | 458999 | ATTCATCCCTTTAAACCACA | 15 | 1883 |

TABLE 26-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040255 | 5011 | 5030 | 459264 | 459283 | TCAGTCCCCCAAACCTTTCC | 20 | 1884 |
| 1040287 | 5407 | 5426 | 459660 | 459679 | GATGCATTCAAAACCCACAA | 21 | 1885 |
| 1040319 | 5766 | 5785 | 460019 | 460038 | TGACTGCAAGAATGAGCCCA | 60 | 1886 |
| 1040351 | 6126 | 6145 | 460379 | 460398 | CAATTATTTTATAATTCCTA | 82 | 1887 |
| 1040383 | 6921 | 6940 | 461174 | 461193 | GTGGACATAGTACAGAGGCA | 7 | 1888 |
| 1040415 | 7388 | 7407 | 461641 | 461660 | AGGCTCACAATTCCAAGTTA | 26 | 1889 |
| 1040447 | 7865 | 7884 | 462118 | 462137 | TGGAGATTTTCTCTCTATG | 36 | 1890 |
| 1040479 | 8228 | 8247 | 462481 | 462500 | CTGTATATTTATTACTTGAT | 7 | 1891 |
| 1040511 | 8566 | 8585 | 462819 | 462838 | TCGACATTCATTTTTCTTTT | 10 | 1892 |
| 1040543 | 8940 | 8959 | 463193 | 463212 | ATGTCAAACATCATCTCTGA | 12 | 1893 |
| 1040575 | 9272 | 9291 | 463525 | 463544 | GGGTGCTTAATATCCCCACA | 115 | 1894 |
| 1040607 | 9637 | 9656 | 463890 | 463909 | GAAGGCCTTCAGATTGGCCA | 101 | 1895 |
| 1040639 | 10163 | 10182 | 464416 | 464435 | AGTCTGGTAGTGCCCTCAAC | 17 | 1896 |
| 1040671 | 10407 | 10426 | 464660 | 464679 | ACAAATAGACACACCACGAT | 77 | 1897 |
| 1040703 | N/A | N/A | 9147 | 9166 | GTTGAGTTACAAATATAAAT | 70 | 1898 |
| 1040735 | N/A | N/A | 25394 | 25413 | CCAGGATTTTAAAAAAGCA | 15 | 1899 |
| 1040767 | N/A | N/A | 40413 | 40432 | GCTAAATTTCCTTAAGCTTT | 42 | 1900 |
| 1040799 | N/A | N/A | 70441 | 70460 | CATCAGTTCCAAAACCTGGA | 83 | 1901 |
| 1040831 | N/A | N/A | 83929 | 83948 | CCAATACACCTTTATTTTTC | 22 | 1902 |
| 1040863 | N/A | N/A | 106559 | 106578 | CGATTAATCCCTTATGTTTT | 4 | 1903 |
| 1040895 | N/A | N/A | 140193 | 140212 | CTCTTCAAAAACATATCCGA | 55 | 1904 |
| 1040927 | N/A | N/A | 163438 | 163457 | TTCTAAATTTAAAACTCCAA | 101 | 1905 |
| 1040959 | N/A | N/A | 186773 | 186792 | ACAGGCAATATTTACTATAA | 1 | 1906 |
| 1040991 | N/A | N/A | 207544 | 207563 | GCCTTCTTCCTTTATAGCAC | 32 | 1907 |
| 1041023 | N/A | N/A | 227246 | 227265 | TTAGGCTATTAAATAATAGA | 124 | 1908 |
| 1041055 | N/A | N/A | 247203 | 247222 | CTCAGTATCTTTTAATTGCC | 29 | 1909 |
| 1041087 | N/A | N/A | 269929 | 269948 | TGGGCCAAAAACACCCCTTT | 95 | 1910 |
| 1041119 | N/A | N/A | 284975 | 284994 | CTGTTTAAAAATGTATTGAG | 23 | 1911 |
| 1041151 | N/A | N/A | 316940 | 316959 | GTCCCTTATCCTTAACACAC | 2 | 1912 |
| 1041183 | N/A | N/A | 334783 | 334802 | CCCTAAATTTAAATTCTCTG | 62 | 1913 |
| 1041215 | N/A | N/A | 358611 | 358630 | ACCTTTATTTAAATTTTCCA | 22 | 1914 |
| 1041247 | N/A | N/A | 380517 | 380536 | GCTCAATATATTTATCTATT | 1 | 1915 |
| 1041279 | N/A | N/A | 410051 | 410070 | TCTGTATTTTAAAAATCTCT | 27 | 1916 |
| 1041311 | N/A | N/A | 437693 | 437712 | CGAGAACCCTTAATCCTGCC | 34 | 1917 |
| 1041343 | N/A | N/A | 438076 | 438095 | CGAAGGCATATACCACTGTA | 48 | 1918 |
| 1041375 | N/A | N/A | 438482 | 438501 | CCACTCTAACCAATCCTAAA | 48 | 1919 |
| 1041407 | N/A | N/A | 439087 | 439106 | TTTTATTTTCTGATGCTTTG | 10 | 1920 |

TABLE 26-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041439 | N/A | N/A | 439432 | 439451 | CATGACTATTTTCAACTCAA | 4 | 1921 |
| 1041471 | N/A | N/A | 440089 | 440108 | GCTGTATTATTATGCCATTT | 12 | 1922 |
| 1041503 | N/A | N/A | 440316 | 440335 | GTCGCATTTCTAAACAAAAC | 64 | 1923 |
| 1041535 | N/A | N/A | 441116 | 441135 | AGTGACAAATCATTGGTTGC | 28 | 1924 |
| 1041567 | N/A | N/A | 441513 | 441532 | AGTCACAATGCCATCTGTTT | 10 | 1925 |
| 1041599 | N/A | N/A | 442147 | 442166 | GCTAATAAATTTTACAAGG | 56 | 1926 |
| 1041631 | N/A | N/A | 442566 | 442585 | TGCTATCACCCTCCACTGAA | 85 | 1927 |
| 1041663 | N/A | N/A | 443017 | 443036 | CTTCCATAAACTCTTTTTAG | 45 | 1928 |
| 1041695 | N/A | N/A | 443387 | 443406 | CAGATGGAAGCCAAAGGCTC | 117 | 1929 |
| 1041727 | N/A | N/A | 443815 | 443834 | CAGCTAATCCATTCAATGCA | 60 | 1930 |
| 1041759 | N/A | N/A | 444223 | 444242 | GCTATAAACAACAACAGTCT | 26 | 1931 |
| 1041791 | N/A | N/A | 445120 | 445139 | CACGGAAGCCCTTAGGCACA | 63 | 1932 |
| 1041823 | N/A | N/A | 445455 | 445474 | GAGAGACCCATTTACTGCAA | 8 | 1933 |
| 1041855 | N/A | N/A | 445739 | 445758 | GTTTTACAAAACATTTTTTC | 56 | 1934 |
| 1041887 | N/A | N/A | 445972 | 445991 | AATTCCTTTCACCACTTAGT | 16 | 1935 |
| 1041919 | N/A | N/A | 446325 | 446344 | CTCTGTCTTTCATCTCTGGA | 49 | 1936 |
| 1041951 | N/A | N/A | 446818 | 446837 | CCCAATGAAAATAAACTCAT | 77 | 1937 |
| 1041983 | N/A | N/A | 447604 | 447623 | CTCTTTCCCCAAACTCAGTG | 30 | 1938 |
| 1042015 | N/A | N/A | 448354 | 448373 | GTTCTATTTAAAATAACAAC | 109 | 1939 |
| 1042047 | N/A | N/A | 448660 | 448679 | TATAAGCAAACTGTATGGGT | 13 | 1940 |
| 1042079 | N/A | N/A | 449037 | 449056 | TCAGGCTTTCCAGTTTTAAT | 16 | 1941 |
| 1042111 | N/A | N/A | 449544 | 449563 | CTCCATCTCAAAACATGCTG | 82 | 1942 |
| 1042143 | N/A | N/A | 449832 | 449851 | CAATGTACTTTTTCCCCCTT | 32 | 1943 |
| 1042175 | N/A | N/A | 450112 | 450131 | AATGAAATTTATGTTAACCT | 75 | 1944 |
| 1042207 | N/A | N/A | 451122 | 451141 | TTGGAGATTTTACTTAATTT | 30 | 1945 |
| 1042239 | N/A | N/A | 451523 | 451542 | ACCGAGATAATATACACAAA | 5 | 1946 |
| 1042271 | N/A | N/A | 451863 | 451882 | TAGGTAAACTTATCTGAGGA | 15 | 1947 |
| 1042303 | N/A | N/A | 452153 | 452172 | TCAGGTGTTAACATCTGTCT | 99 | 1948 |
| 1042335 | N/A | N/A | 452453 | 452472 | CTCATACAATTCTAGTTACC | 45 | 1949 |
| 1042367 | N/A | N/A | 452919 | 452938 | GGGAAAGTTTCATTGTTCTG | 24 | 1950 |
| 1042399 | N/A | N/A | 453742 | 453761 | GCAAAAGATCCTTCCAGAA | 62 | 1951 |
| 1042431 | N/A | N/A | 454491 | 454510 | GCTAACAGACACATAATTTG | 111 | 1952 |
| 1042463 | N/A | N/A | 455199 | 455218 | CACTAGCAAAATATCAGATC | 54 | 1953 |
| 1042495 | N/A | N/A | 456155 | 456174 | AACTTTTTTCTTATAGTAC | 66 | 1954 |
| 1042527 | N/A | N/A | 456877 | 456896 | TTCAAAATATTCCATCAAGT | 25 | 1955 |

TABLE 27

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 1 | 138 |
| 1040096 | 1932 | 1951 | 436651 | 436670 | TCACCGTTCAGGACCTCCTT | 70 | 1956 |
| 1040128 | 3046 | 3065 | 457299 | 457318 | GCCCTTTTTAACAGAGCCGT | 122 | 1957 |
| 1040160 | 3669 | 3688 | 457922 | 457941 | GCCCCGTTCCTTTCTTCCCC | 67 | 1958 |
| 1040192 | 4313 | 4332 | 458566 | 458585 | GGGAGTGAAGTCAATGCAAT | 17 | 1959 |
| 1040224 | 4728 | 4747 | 458981 | 459000 | CATTCATCCCTTTAAACCAC | 22 | 1960 |
| 1040256 | 5013 | 5032 | 459266 | 459285 | GTTCAGTCCCCCAAACCTTT | 16 | 1961 |
| 1040288 | 5408 | 5427 | 459661 | 459680 | AGATGCATTCAAAACCCACA | 21 | 1962 |
| 1040320 | 5785 | 5804 | 460038 | 460057 | CAGCACTAAATAAGCAGTAT | 11 | 1963 |
| 1040352 | 6128 | 6147 | 460381 | 460400 | ACCAATTATTTTATAATTCC | 59 | 1964 |
| 1040384 | 6941 | 6960 | 461194 | 461213 | CTGTCGGTAAATATTGCAAA | 10 | 1965 |
| 1040416 | 7404 | 7423 | 461657 | 461676 | CTAACAGAAAACATAGAGGC | 28 | 1966 |
| 1040448 | 7866 | 7885 | 462119 | 462138 | TTGGAGATTTTCTCTCTAT | 54 | 1967 |
| 1040480 | 8229 | 8248 | 462482 | 462501 | TCTGTATATTTATTACTTGA | 10 | 1968 |
| 1040512 | 8597 | 8616 | 462850 | 462869 | GCCATATCTTTCAAACACTG | 8 | 1969 |
| 1040544 | 8941 | 8960 | 463194 | 463213 | AATGTCAAACATCATCTCTG | 13 | 1970 |
| 1040576 | 9292 | 9311 | 463545 | 463564 | AATTTAAGAATTGTAAGTGG | 123 | 1971 |
| 1040608 | 9640 | 9659 | 463893 | 463912 | AACGAAGGCCTTCAGATTGG | 107 | 1972 |
| 1040640 | 10189 | 10208 | 464442 | 464461 | TAGTTCTCCTCTGTACTGGC | 14 | 1973 |
| 1040672 | 10409 | 10428 | 464662 | 464681 | CTACAAATAGACACACCACG | 70 | 1974 |
| 1040704 | N/A | N/A | 9365 | 9384 | AACAGTAGCCAAAATGTTCT | 100 | 1975 |
| 1040736 | N/A | N/A | 25410 | 25429 | CTAGAATTTTAAAAAACCAG | 80 | 1976 |
| 1040768 | N/A | N/A | 40502 | 40521 | AGTACAATCTTTTATAGATA | 89 | 1977 |
| 1040800 | N/A | N/A | 70463 | 70482 | TGCCTGAGAATTTAATACTA | 72 | 1978 |
| 1040832 | N/A | N/A | 84147 | 84166 | AGTAAGCTTCTTTAACTTTA | 11 | 1979 |
| 1040864 | N/A | N/A | 107690 | 107709 | TGGATAATTATTTAATTCAT | 70 | 1980 |
| 1040896 | N/A | N/A | 140329 | 140348 | CCAAACTAAGAATAATCTAG | 89 | 1981 |
| 1040928 | N/A | N/A | 165500 | 165519 | GAGGAAATTATTTACTGGCT | 5 | 1982 |
| 1040960 | N/A | N/A | 187228 | 187247 | ATGCACATACAAATAAGCTC | 51 | 1983 |
| 1040992 | N/A | N/A | 207564 | 207583 | GAGATTAAAATACAATTGCT | 36 | 1984 |
| 1041024 | N/A | N/A | 227353 | 227372 | GATTTCTCCTTTTAACCTCT | 23 | 1985 |
| 1041056 | N/A | N/A | 248796 | 248815 | TTCTCAAAACCTTATCTCCT | 92 | 1986 |
| 1041088 | N/A | N/A | 270452 | 270471 | CATTTATTCCTTATCCTAC | 118 | 1987 |
| 1041120 | N/A | N/A | 285644 | 285663 | CATTTGCACCTTTAATTTGT | 24 | 1988 |
| 1041152 | N/A | N/A | 316955 | 316974 | TTCCAAAAGAATGTGTCCC | 16 | 1989 |
| 1041184 | N/A | N/A | 335393 | 335412 | GGTAGCTATCATTATTAAGC | 19 | 1990 |
| 1041216 | N/A | N/A | 358821 | 358840 | CGACAGAAAATATATCTGCT | 47 | 1991 |

TABLE 27-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041248 | N/A | N/A | 382312 | 382331 | GACTGCAAAATTCCCATTGC | 28 | 1992 |
| 1041280 | N/A | N/A | 410115 | 410134 | CTGTAAAAATACACATCCTC | 38 | 1993 |
| 1041312 | N/A | N/A | 437695 | 437714 | CCCGAGAACCCTTAATCCTG | 37 | 1994 |
| 1041344 | N/A | N/A | 438160 | 438179 | CACAGGTTCAGCCATAGCTC | 21 | 1995 |
| 1041376 | N/A | N/A | 438483 | 438502 | TCCACTCTAACCAATCCTAA | 66 | 1996 |
| 1041408 | N/A | N/A | 439090 | 439109 | CGCTTTTATTTTCTGATGCT | 20 | 1997 |
| 1041440 | N/A | N/A | 439433 | 439452 | TCATGACTATTTTCAACTCA | 18 | 1998 |
| 1041472 | N/A | N/A | 440090 | 440109 | AGCTGTATTATTATGCCATT | 43 | 1999 |
| 1041504 | N/A | N/A | 440317 | 440336 | AGTCGCATTTCTAAACAAAA | 66 | 2000 |
| 1041536 | N/A | N/A | 441117 | 441136 | AAGTGACAAATCATTGGTTG | 21 | 2001 |
| 1041568 | N/A | N/A | 441519 | 441538 | GCCTAGAGTCACAATGCCAT | 33 | 2002 |
| 1041600 | N/A | N/A | 442148 | 442167 | CGCTAATAAATTTTTACAAG | 91 | 2003 |
| 1041632 | N/A | N/A | 442620 | 442639 | TCAACCAGAATCAAGGCATG | 66 | 2004 |
| 1041664 | N/A | N/A | 443022 | 443041 | CTCTCCTTCCATAAACTCTT | 69 | 2005 |
| 1041696 | N/A | N/A | 443410 | 443429 | GATGGGATAATATAGAACGC | 45 | 2006 |
| 1041728 | N/A | N/A | 443816 | 443835 | CCAGCTAATCCATTCAATGC | 34 | 2007 |
| 1041760 | N/A | N/A | 444225 | 444244 | ATGCTATAAACAACAACAGT | 47 | 2008 |
| 1041792 | N/A | N/A | 445122 | 445141 | GACACGGAAGCCCTTAGGCA | 46 | 2009 |
| 1041824 | N/A | N/A | 445457 | 445476 | GCGAGAGACCCATTTACTGC | 11 | 2010 |
| 1041856 | N/A | N/A | 445746 | 445765 | GGCATCTGTTTTACAAAACA | 9 | 2011 |
| 1041888 | N/A | N/A | 445977 | 445996 | AATAAAATTCCTTTCACCAC | 35 | 2012 |
| 1041920 | N/A | N/A | 446352 | 446371 | CTTTATACTTTTGTAAGCTT | 29 | 2013 |
| 1041952 | N/A | N/A | 446819 | 446838 | TCCCAATGAAAATAAACTCA | 108 | 2014 |
| 1041984 | N/A | N/A | 447606 | 447625 | GCCTCTTTCCCCAAACTCAG | 29 | 2015 |
| 1042016 | N/A | N/A | 448356 | 448375 | CAGTTCTATTTAAAATAACA | 117 | 2016 |
| 1042048 | N/A | N/A | 448668 | 448687 | ATCCCAATTATAAGCAAACT | 64 | 2017 |
| 1042080 | N/A | N/A | 449039 | 449058 | TTTCAGGCTTTCCAGTTTTA | 20 | 2018 |
| 1042112 | N/A | N/A | 449545 | 449564 | TCTCCATCTCAAAACATGCT | 108 | 2019 |
| 1042144 | N/A | N/A | 449841 | 449860 | CTACCTAGACAATGTACTTT | 86 | 2020 |
| 1042176 | N/A | N/A | 450127 | 450146 | CCCACCTGGCCTGTTAATGA | 86 | 2021 |
| 1042208 | N/A | N/A | 451135 | 451154 | CCAGCCTAAAAAATTGGAGA | 94 | 2022 |
| 1042240 | N/A | N/A | 451524 | 451543 | CACCGAGATAATATACACAA | 18 | 2023 |
| 1042272 | N/A | N/A | 451875 | 451894 | ACTGTGTTCTCATAGGTAAA | 32 | 2024 |
| 1042304 | N/A | N/A | 452173 | 452192 | AAGTCATAAAAATAAAACTC | 99 | 2025 |
| 1042336 | N/A | N/A | 452454 | 452473 | ACTCATACAATTCTAGTTAC | 44 | 2026 |
| 1042368 | N/A | N/A | 452952 | 452971 | AGCATGAACCCCTTCTCCTG | 78 | 2027 |

TABLE 27-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1042400 | N/A | N/A | 453743 | 453762 | AGCAAAAGATCCTTCCAGA | 90 | 2028 |
| 1042432 | N/A | N/A | 454556 | 454575 | ATAGAGACAAAAGATGGTC | 104 | 2029 |
| 1042464 | N/A | N/A | 455200 | 455219 | GCACTAGCAAAATATCAGAT | 28 | 2030 |
| 1042496 | N/A | N/A | 456172 | 456191 | TCTGGACAAAATGTTTAAAC | 35 | 2031 |
| 1042528 | N/A | N/A | 456881 | 456900 | AATATTCAAAATATTCCATC | 64 | 2032 |

TABLE 28

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 2 | 138 |
| 1040097 | 1933 | 1952 | 436652 | 436671 | CTCACCGTTCAGGACCTCCT | 73 | 2033 |
| 1040129 | 3048 | 3067 | 457301 | 457320 | TGGCCCTTTTTAACAGAGCC | 113 | 2034 |
| 1040161 | 3670 | 3689 | 457923 | 457942 | AGCCCCGTTCCTTTCTTCCC | 46 | 2035 |
| 1040193 | 4328 | 4347 | 458581 | 458600 | TTGCATCTACCTCTTGGGAG | 44 | 2036 |
| 1040225 | 4729 | 4748 | 458982 | 459001 | ACATTCATCCCTTTAAACCA | 33 | 2037 |
| 1040257 | 5032 | 5051 | 459285 | 459304 | GCTACATTTATTTATGCTCG | 14 | 2038 |
| 1040289 | 5417 | 5436 | 459670 | 459689 | GCACTTTAAAGATGCATTCA | 29 | 2039 |
| 1040321 | 5786 | 5805 | 460039 | 460058 | ACAGCACTAAATAAGCAGTA | 28 | 2040 |
| 1040353 | 6129 | 6148 | 460382 | 460401 | AACCAATTATTTTATAATTC | 112 | 2041 |
| 1040385 | 6942 | 6961 | 461195 | 461214 | GCTGTCGGTAAATATTGCAA | 36 | 2042 |
| 1040417 | 7406 | 7425 | 461659 | 461678 | ACCTAACAGAAAACATAGAG | 36 | 2043 |
| 1040449 | 7882 | 7901 | 462135 | 462154 | AGTGTCTTCAAAAGCATTGG | 22 | 2044 |
| 1040481 | 8231 | 8250 | 462484 | 462503 | TCTCTGTATATTTATTACTT | 10 | 2045 |
| 1040513 | 8598 | 8617 | 462851 | 462870 | AGCCATATCTTTCAAACACT | 8 | 2046 |
| 1040545 | 8973 | 8992 | 463226 | 463245 | TCTTTGGGTTTATAGGAACA | 14 | 2047 |
| 1040577 | 9297 | 9316 | 463550 | 463569 | TTCTGAATTTAAGAATTGTA | 83 | 2048 |
| 1040609 | 9647 | 9666 | 463900 | 463919 | CACTTCCAACGAAGGCCTTC | 100 | 2049 |
| 1040641 | 10192 | 10211 | 464445 | 464464 | CCCTAGTTCTCCTCTGTACT | 79 | 2050 |
| 1040673 | 10414 | 10433 | 464667 | 464686 | GTATCCTACAAATAGACACA | 56 | 2051 |
| 1040705 | N/A | N/A | 9443 | 9462 | ACTCACTATTTTAAGAGCA | 49 | 2052 |
| 1040737 | N/A | N/A | 25793 | 25812 | CTGGGAATTTAAAAAACAAA | 77 | 2053 |
| 1040769 | N/A | N/A | 40905 | 40924 | TCCATAAACATTTATACAGA | 5 | 2054 |
| 1040801 | N/A | N/A | 71139 | 71158 | GGTTCAAAACCTTAGTCAGA | 69 | 2055 |
| 1040833 | N/A | N/A | 85391 | 85410 | ATAGAATATTTTTATCATTC | 91 | 2056 |
| 1040865 | N/A | N/A | 108193 | 108212 | GAATAAATTATTTACTGCGG | 8 | 2057 |

TABLE 28-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040897 | N/A | N/A | 140551 | 140570 | GGTCAATTTCAAACTGTTCT | 5 | 2058 |
| 1040929 | N/A | N/A | 166245 | 166264 | GGCCTAAAACTATTCTTGAT | 118 | 2059 |
| 1040961 | N/A | N/A | 187483 | 187502 | ACACTTAAACCTGTTAATAT | 78 | 2060 |
| 1040993 | N/A | N/A | 208043 | 208062 | GCTCATAAAATACCTCTCTA | 16 | 2061 |
| 1041025 | N/A | N/A | 227432 | 227451 | CCAGGAAAGATTTATTTAGC | 51 | 2062 |
| 1041057 | N/A | N/A | 250936 | 250955 | AGCACATTTCAAAAGTTCAG | 53 | 2063 |
| 1041089 | N/A | N/A | 270476 | 270495 | ATTCATTTTCCTTATGTTAC | 58 | 2064 |
| 1041121 | N/A | N/A | 286774 | 286793 | TCACCCAAACCCATTGCCTA | 77 | 2065 |
| 1041153 | N/A | N/A | 317256 | 317275 | TTCTGTAAAATATATCCTGT | 19 | 2066 |
| 1041185 | N/A | N/A | 335931 | 335950 | ATCTGTAAAATATGGTTGCA | 7 | 2067 |
| 1041217 | N/A | N/A | 362937 | 362956 | AACTTATTTAAAGTGTCCA | 2 | 2068 |
| 1041249 | N/A | N/A | 385646 | 385665 | ACATTATCCCTTAATATCC | 39 | 2069 |
| 1041281 | N/A | N/A | 410116 | 410135 | GCTGTAAAAATACACATCCT | 18 | 2070 |
| 1041313 | N/A | N/A | 437751 | 437770 | GCTTATTTTTTCTAGAGAAC | 54 | 2071 |
| 1041345 | N/A | N/A | 438169 | 438188 | AGTGATAGTCACAGGTTCAG | 12 | 2072 |
| 1041377 | N/A | N/A | 438486 | 438505 | TTATCCACTCTAACCAATCC | 101 | 2073 |
| 1041409 | N/A | N/A | 439093 | 439112 | CCACGCTTTTATTTTCTGAT | 1 | 2074 |
| 1041441 | N/A | N/A | 439441 | 439460 | CAGCTATTTCATGACTATTT | 7 | 2075 |
| 1041473 | N/A | N/A | 440091 | 440110 | GAGCTGTATTATTATGCCAT | 107 | 2076 |
| 1041505 | N/A | N/A | 440318 | 440337 | CAGTCGCATTTCTAAACAAA | 76 | 2077 |
| 1041537 | N/A | N/A | 441122 | 441141 | CGGTAAAGTGACAAATCATT | 12 | 2078 |
| 1041569 | N/A | N/A | 441521 | 441540 | CTGCCTAGAGTCACAATGCC | 31 | 2079 |
| 1041601 | N/A | N/A | 442149 | 442168 | ACGCTAATAAATTTTTACAA | 109 | 2080 |
| 1041633 | N/A | N/A | 442624 | 442643 | ACTCTCAACCAGAATCAAGG | 86 | 2081 |
| 1041665 | N/A | N/A | 443023 | 443042 | CCTCTCCTTCCATAAACTCT | 85 | 2082 |
| 1041697 | N/A | N/A | 443457 | 443476 | CTGTGTACTCTTCAGAGAAG | 27 | 2083 |
| 1041729 | N/A | N/A | 443817 | 443836 | ACCAGCTAATCCATTCAATG | 17 | 2084 |
| 1041761 | N/A | N/A | 444251 | 444270 | AACAATAGTCTTTAATTTTT | 109 | 2085 |
| 1041793 | N/A | N/A | 445143 | 445162 | GTGAGTGACCACAGCAGCTG | 110 | 2086 |
| 1041825 | N/A | N/A | 445458 | 445477 | AGCGAGAGACCCATTTACTG | 23 | 2087 |
| 1041857 | N/A | N/A | 445767 | 445786 | CTGTTTTCACAAATTGCGAA | 44 | 2088 |
| 1041889 | N/A | N/A | 445978 | 445997 | CAATAAAATTCCTTTCACCA | 37 | 2089 |
| 1041921 | N/A | N/A | 446354 | 446373 | GCCTTTATACTTTTGTAAGC | 73 | 2090 |
| 1041953 | N/A | N/A | 446832 | 446851 | GTTTCTGATTAAATCCCAAT | 18 | 2091 |
| 1041985 | N/A | N/A | 447607 | 447626 | TGCCTCTTTCCCCAAACTCA | 47 | 2092 |
| 1042017 | N/A | N/A | 448370 | 448389 | GAGAACTCCCCTGACAGTTC | 90 | 2093 |

TABLE 28-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1042049 | N/A | N/A | 448679 | 448698 | ACATCACAAACATCCCAATT | 71 | 2094 |
| 1042081 | N/A | N/A | 449045 | 449064 | GATACATTTCAGGCTTTCCA | 13 | 2095 |
| 1042113 | N/A | N/A | 449571 | 449590 | CTTGAAATTCCCTTGGAGAG | 42 | 2096 |
| 1042145 | N/A | N/A | 449843 | 449862 | AACTACCTAGACAATGTACT | 65 | 2097 |
| 1042177 | N/A | N/A | 450452 | 450471 | CGTACTAAAACAAGATGACG | 51 | 2098 |
| 1042209 | N/A | N/A | 451136 | 451155 | ACCAGCCTAAAAAATTGGAG | 72 | 2099 |
| 1042241 | N/A | N/A | 451525 | 451544 | GCACCGAGATAATATACACA | 13 | 2100 |
| 1042273 | N/A | N/A | 451891 | 451910 | TCTGAAAATAACATCTACTG | 43 | 2101 |
| 1042305 | N/A | N/A | 452175 | 452194 | CCAAGTCATAAAAATAAAAC | 104 | 2102 |
| 1042337 | N/A | N/A | 452460 | 452479 | ATAGCCACTCATACAATTCT | 34 | 2103 |
| 1042369 | N/A | N/A | 452953 | 452972 | AAGCATGAACCCCTTCTCCT | 66 | 2104 |
| 1042401 | N/A | N/A | 453745 | 453764 | GGAGCAAAAGATCCTTCCA | 91 | 2105 |
| 1042433 | N/A | N/A | 454600 | 454619 | GGATTCTCTAATTAGAGCTT | 41 | 2106 |
| 1042465 | N/A | N/A | 455224 | 455243 | GAGGAGACCAGATAGCTTGT | 79 | 2107 |
| 1042497 | N/A | N/A | 456173 | 456192 | CTCTGGACAAAATGTTTAAA | 82 | 2108 |
| 1042529 | N/A | N/A | 456883 | 456902 | TCAATATTCAAAATATTCCA | 98 | 2109 |

TABLE 29

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 3 | 138 |
| 1040098 | 2110 | 2129 | 436829 | 436848 | GGGCAGGACCATCACAGAGG | 60 | 2110 |
| 1040130 | 3049 | 3068 | 457302 | 457321 | CTGGCCCTTTTTAACAGAGC | 107 | 2111 |
| 1040162 | 3765 | 3784 | 458018 | 458037 | CTGCAGGACCCTTCCCACGG | 118 | 2112 |
| 1040194 | 4393 | 4412 | 458646 | 458665 | TCAAAGACAAAAAGATTTCG | 75 | 2113 |
| 1040226 | 4733 | 4752 | 458986 | 459005 | ATTCACATTCATCCCTTTAA | 35 | 2114 |
| 1040258 | 5048 | 5067 | 459301 | 459320 | GTTAGAAAGAAATTTTGCTA | 58 | 2115 |
| 1040290 | 5442 | 5461 | 459695 | 459714 | CCTACTTATAAAACTTTTTT | 114 | 2116 |
| 1040322 | 5787 | 5806 | 460040 | 460059 | TACAGCACTAAATAAGCAGT | 68 | 2117 |
| 1040354 | 6177 | 6196 | 460430 | 460449 | CACATGCTAAAAAGCAAGA | 86 | 2118 |
| 1040386 | 6960 | 6979 | 461213 | 461232 | AAGAAAGAACAAAAGACGGC | 66 | 2119 |
| 1040418 | 7407 | 7426 | 461660 | 461679 | CACCTAACAGAAAACATAGA | 118 | 2120 |
| 1040450 | 7883 | 7902 | 462136 | 462155 | TAGTGTCTTCAAAAGCATTG | 39 | 2121 |
| 1040482 | 8238 | 8257 | 462491 | 462510 | AGTATATTCTCTGTATATTT | 29 | 2122 |

TABLE 29-continued

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040514 | 8599 | 8618 | 462852 | 462871 | GAGCCATATCTTTCAAACAC | 25 | 2123 |
| 1040546 | 8986 | 9005 | 463239 | 463258 | TTCAAGATTATATTCTTTGG | 52 | 2124 |
| 1040578 | 9328 | 9347 | 463581 | 463600 | GTTGCCTTCAACGAGAAGGG | 62 | 2125 |
| 1040610 | 9658 | 9677 | 463911 | 463930 | ACTGTAAACAACACTTCCAA | 22 | 2126 |
| 1040642 | 10204 | 10223 | 464457 | 464476 | ACATCATTCCTTCCCTAGTT | 29 | 2127 |
| 1040674 | 10415 | 10434 | 464668 | 464687 | TGTATCCTACAAATAGACAC | 78 | 2128 |
| 1040706 | N/A | N/A | 9658 | 9677 | GGCTGATTTTAAACTTAGTT | 31 | 2129 |
| 1040738 | N/A | N/A | 26160 | 26179 | GTTTTATATTTTAAGTGCT | 7 | 2130 |
| 1040770 | N/A | N/A | 40931 | 40950 | ACATTTAAAATATTTCAGAC | 108 | 2131 |
| 1040802 | N/A | N/A | 71486 | 71505 | TGTCTATTTTAAAGACTCAA | 112 | 2132 |
| 1040834 | N/A | N/A | 85731 | 85750 | GGATATCTATTTTAATTCTT | 62 | 2133 |
| 1040866 | N/A | N/A | 108791 | 108810 | ACAGTATTTCAAAAGAAGCC | 73 | 2134 |
| 1040898 | N/A | N/A | 140712 | 140731 | CTGGATAATACCTAACTGTC | 58 | 2135 |
| 1040930 | N/A | N/A | 167395 | 167414 | AGTGACTTAGATTATCCTTT | 17 | 2136 |
| 1040962 | N/A | N/A | 187991 | 188010 | CACATCAAACCTCAAGGGCA | 64 | 2137 |
| 1040994 | N/A | N/A | 208238 | 208257 | GTTTCCCTAATTTATGGAGT | 52 | 2138 |
| 1041026 | N/A | N/A | 227529 | 227548 | ATTCTTACAATTTACTTGTA | 96 | 2139 |
| 1041058 | N/A | N/A | 251431 | 251450 | ATTCTCTTTTAAAGATAAAG | 119 | 2140 |
| 1041090 | N/A | N/A | 270489 | 270508 | CTATGGTTTTAAAATTCATT | 82 | 2141 |
| 1041122 | N/A | N/A | 287171 | 287190 | ACTACCAGCCCTTATTTCAG | 20 | 2142 |
| 1041154 | N/A | N/A | 318500 | 318519 | CTCTGCTTTCAAATGTGTTT | 6 | 2143 |
| 1041186 | N/A | N/A | 338862 | 338881 | TCTTTCATATTTTAAAGTGC | 3 | 2144 |
| 1041218 | N/A | N/A | 365191 | 365210 | TCCAGTAAAAACACAACACT | 44 | 2145 |
| 1041250 | N/A | N/A | 385654 | 385673 | TATAATATACATTATACCCT | 78 | 2146 |
| 1041282 | N/A | N/A | 410286 | 410305 | CCACAATTACAAACACACTT | 41 | 2147 |
| 1041314 | N/A | N/A | 437752 | 437771 | GGCTTATTTTTTCTAGAGAA | 18 | 2148 |
| 1041346 | N/A | N/A | 438171 | 438190 | GCAGTGATAGTCACAGGTTC | 19 | 2149 |
| 1041378 | N/A | N/A | 438490 | 438509 | GGAATTATCCACTCTAACCA | 56 | 2150 |
| 1041410 | N/A | N/A | 439101 | 439120 | TGTATTAACCACGCTTTTAT | 31 | 2151 |
| 1041442 | N/A | N/A | 439443 | 439462 | AGCAGCTATTTCATGACTAT | 19 | 2152 |
| 1041474 | N/A | N/A | 440093 | 440112 | GTGAGCTGTATTATTATGCC | 62 | 2153 |
| 1041506 | N/A | N/A | 440327 | 440346 | GCAAGGAACCAGTCGCATTT | 56 | 2154 |
| 1041538 | N/A | N/A | 441144 | 441163 | AGCCGATTTCTGATAGGCTC | 78 | 2155 |
| 1041570 | N/A | N/A | 441530 | 441549 | GCAGGATTTCTGCCTAGAGT | 39 | 2156 |
| 1041602 | N/A | N/A | 442188 | 442207 | ATGTTCATCTTAATGCTCTT | 21 | 2157 |
| 1041634 | N/A | N/A | 442625 | 442644 | GACTCTCAACCAGAATCAAG | 111 | 2158 |

TABLE 29-continued

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041666 | N/A | N/A | 443025 | 443044 | TGCCTCTCCTTCCATAAACT | 89 | 2159 |
| 1041698 | N/A | N/A | 443481 | 443500 | TTTTACAACTCCACTGAGCA | 53 | 2160 |
| 1041730 | N/A | N/A | 443834 | 443853 | CTCGGCTATTTTTAGGTACC | 51 | 2161 |
| 1041762 | N/A | N/A | 444258 | 444277 | TGCTTTAAACAATAGTCTTT | 81 | 2162 |
| 1041794 | N/A | N/A | 445146 | 445165 | CCAGTGAGTGACCACAGCAG | 99 | 2163 |
| 1041826 | N/A | N/A | 445484 | 445503 | ACCCCGTCTCAAAGATGAAG | 102 | 2164 |
| 1041858 | N/A | N/A | 445769 | 445788 | CCCTGTTTTCACAAATTGCG | 62 | 2165 |
| 1041890 | N/A | N/A | 445979 | 445998 | TCAATAAAATTCCTTTCACC | 60 | 2166 |
| 1041922 | N/A | N/A | 446355 | 446374 | GGCCTTTATACTTTTGTAAG | 103 | 2167 |
| 1041954 | N/A | N/A | 446834 | 446853 | TGGTTTCTGATTAAATCCCA | 49 | 2168 |
| 1041986 | N/A | N/A | 447630 | 447649 | TTTACTTGTATATTTGTCTG | 15 | 2169 |
| 1042018 | N/A | N/A | 448384 | 448403 | CTGTCCTTTTCAGAGAGAAC | 88 | 2170 |
| 1042050 | N/A | N/A | 448680 | 448699 | TACATCACAAACATCCCAAT | 97 | 2171 |
| 1042082 | N/A | N/A | 449048 | 449067 | AATGATACATTTCAGGCTTT | 47 | 2172 |
| 1042114 | N/A | N/A | 449591 | 449610 | ATATATCATCAAATCTGTTG | 44 | 2173 |
| 1042146 | N/A | N/A | 449851 | 449870 | TTAGTGTGAACTACCTAGAC | 85 | 2174 |
| 1042178 | N/A | N/A | 450505 | 450524 | CTGCCGAAAAATTCACGAGA | 95 | 2175 |
| 1042210 | N/A | N/A | 451137 | 451156 | AACCAGCCTAAAAAATTGGA | 88 | 2176 |
| 1042242 | N/A | N/A | 451539 | 451558 | AGGATAATTTTATGGCACCG | 14 | 2177 |
| 1042274 | N/A | N/A | 451905 | 451924 | GCAATATTTAATTTTCTGAA | 36 | 2178 |
| 1042306 | N/A | N/A | 452185 | 452204 | TGCTGCAAATCCAAGTCATA | 51 | 2179 |
| 1042338 | N/A | N/A | 452464 | 452483 | CCTTATAGCCACTCATACAA | 42 | 2180 |
| 1042370 | N/A | N/A | 452976 | 452995 | AGTACATTCATATGGCAGCT | 27 | 2181 |
| 1042402 | N/A | N/A | 453759 | 453778 | GGCGAATTCTATATGGAGCA | 98 | 2182 |
| 1042434 | N/A | N/A | 454604 | 454623 | AACTGGATTCTCTAATTAGA | 59 | 2183 |
| 1042466 | N/A | N/A | 455257 | 455276 | GCATTCAATTTAAAAAAGGG | 66 | 2184 |
| 1042498 | N/A | N/A | 456187 | 456206 | AATAAATTTAAAAACTCTGG | 108 | 2185 |
| 1042530 | N/A | N/A | 456884 | 456903 | ATCAATATTCAAAATATTCC | 89 | 2186 |

TABLE 30

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 2 | 138 |
| 1040099 | 2149 | 2168 | 436868 | 436887 | CTGTTGCACCTCCAGGTCAG | 77 | 2187 |

TABLE 30-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040131 | 3050 | 3069 | 457303 | 457322 | GCTGGCCCTTTTTAACAGAG | 110 | 2188 |
| 1040163 | 3800 | 3819 | 458053 | 458072 | CCTGTGCACCCCCACATGCG | 107 | 2189 |
| 1040195 | 4416 | 4435 | 458669 | 458688 | TGAACTATAAACAGTACTAG | 69 | 2190 |
| 1040227 | 4734 | 4753 | 458987 | 459006 | AATTCACATTCATCCCTTTA | 34 | 2191 |
| 1040259 | 5079 | 5098 | 459332 | 459351 | AACCTTATAAAATGGCCTAG | 70 | 2192 |
| 1040291 | 5446 | 5465 | 459699 | 459718 | TCTCCCTACTTATAAAACTT | 31 | 2193 |
| 1040323 | 5788 | 5807 | 460041 | 460060 | ATACAGCACTAAATAAGCAG | 77 | 2194 |
| 1040355 | 6207 | 6226 | 460460 | 460479 | GGTCAGACTCTATTGGCACA | 10 | 2195 |
| 1040387 | 6987 | 7006 | 461240 | 461259 | TTACTAGTTTAAAAATGGAA | 100 | 2196 |
| 1040419 | 7414 | 7433 | 461667 | 461686 | ACACACTCACCTAACAGAAA | 68 | 2197 |
| 1040451 | 7915 | 7934 | 462168 | 462187 | CTTCCTCACCCATATCTGAA | 45 | 2198 |
| 1040483 | 8250 | 8269 | 462503 | 462522 | GCTTTATAAAAAGTATATT | 139 | 2199 |
| 1040515 | 8600 | 8619 | 462853 | 462872 | AGAGCCATATCTTTCAAACA | 31 | 2200 |
| 1040547 | 8988 | 9007 | 463241 | 463260 | TGTTCAAGATTATATTCTTT | 73 | 2201 |
| 1040579 | 9332 | 9351 | 463585 | 463604 | AACAGTTGCCTTCAACGAGA | 29 | 2202 |
| 1040611 | 9661 | 9680 | 463914 | 463933 | ATTACTGTAAACAACACTTC | 52 | 2203 |
| 1040643 | 10205 | 10224 | 464458 | 464477 | AACATCATTCCTTCCCTAGT | 33 | 2204 |
| 1040675 | 10418 | 10437 | 464671 | 464690 | GAGTGTATCCTACAAATAGA | 53 | 2205 |
| 1040707 | N/A | N/A | 11372 | 11391 | TCTAGCAAACCTCTTTTTCC | 57 | 2206 |
| 1040739 | N/A | N/A | 27282 | 27301 | AGGTATAAATCCCCTTTCCA | 31 | 2207 |
| 1040771 | N/A | N/A | 41291 | 41310 | GATAGTAATCAAACCTGAGT | 43 | 2208 |
| 1040803 | N/A | N/A | 71489 | 71508 | ATTTGTCTATTTTAAAGACT | 117 | 2209 |
| 1040835 | N/A | N/A | 87443 | 87462 | ATGAGTAAAATATGGTCCTT | 43 | 2210 |
| 1040867 | N/A | N/A | 109082 | 109101 | CACTTCATAATTTAATATTT | 92 | 2211 |
| 1040899 | N/A | N/A | 141267 | 141286 | GTGATATTTTAAAGACTTAC | 6 | 2212 |
| 1040931 | N/A | N/A | 168114 | 168133 | AGGGCCTTATTTTAATCACA | 106 | 2213 |
| 1040963 | N/A | N/A | 188513 | 188532 | CATTTATTTCCTTACCCAGT | 6 | 2214 |
| 1040995 | N/A | N/A | 208356 | 208375 | GTGTCTAAAACCAACTGGGT | 28 | 2215 |
| 1041027 | N/A | N/A | 227703 | 227722 | AAGCCAATATTTTATTTTGA | 96 | 2216 |
| 1041059 | N/A | N/A | 251853 | 251872 | GGTGATAAAGATATCATTAC | 67 | 2217 |
| 1041091 | N/A | N/A | 270781 | 270800 | TTCGAAATTCTTTATTTGAT | 136 | 2218 |
| 1041123 | N/A | N/A | 287520 | 287539 | CACTATAAAGAATGATGAGT | 5 | 2219 |
| 1041155 | N/A | N/A | 318566 | 318585 | TAGAGAAAACGATGTTGGCT | 3 | 2220 |
| 1041187 | N/A | N/A | 339528 | 339547 | CCTTCGGCTATTTAATAATA | 75 | 2221 |
| 1041219 | N/A | N/A | 365605 | 365624 | AGGCATCTAATTTAAATTCA | 20 | 2222 |
| 1041251 | N/A | N/A | 386171 | 386190 | GCTTGTAAAACTATGGCGGC | 87 | 2223 |

TABLE 30-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041283 | N/A | N/A | 413867 | 413886 | GGCAATAAAATATTTAATGG | 71 | 2224 |
| 1041315 | N/A | N/A | 437753 | 437772 | GGGCTTATTTTTTCTAGAGA | 33 | 2225 |
| 1041347 | N/A | N/A | 438223 | 438242 | ACATTATATATATGTTGGAG | 16 | 2226 |
| 1041379 | N/A | N/A | 438493 | 438512 | ACTGGAATTATCCACTCTAA | 40 | 2227 |
| 1041411 | N/A | N/A | 439103 | 439122 | ATTGTATTAACCACGCTTTT | 29 | 2228 |
| 1041443 | N/A | N/A | 439444 | 439463 | TAGCAGCTATTTCATGACTA | 15 | 2229 |
| 1041475 | N/A | N/A | 440117 | 440136 | GTGAACAGCCACTACAGAGG | 76 | 2230 |
| 1041507 | N/A | N/A | 440360 | 440379 | CCTTCATTCTCAAGCTGAAG | 88 | 2231 |
| 1041539 | N/A | N/A | 441150 | 441169 | GATGTCAGCCGATTTCTGAT | 30 | 2232 |
| 1041571 | N/A | N/A | 441554 | 441573 | AGGCATCCTCAAGAGTCTGT | 32 | 2233 |
| 1041603 | N/A | N/A | 442192 | 442211 | GTACATGTTCATCTTAATGC | 12 | 2234 |
| 1041635 | N/A | N/A | 442626 | 442645 | GGACTCTCAACCAGAATCAA | 118 | 2235 |
| 1041667 | N/A | N/A | 443027 | 443046 | GCTGCCTCTCCTTCCATAAA | 64 | 2236 |
| 1041699 | N/A | N/A | 443488 | 443507 | CAATACATTTTACAACTCCA | 27 | 2237 |
| 1041731 | N/A | N/A | 443871 | 443890 | CTGACTCTACAGGCTCATGT | 51 | 2238 |
| 1041763 | N/A | N/A | 444259 | 444278 | CTGCTTTAAACAATAGTCTT | 70 | 2239 |
| 1041795 | N/A | N/A | 445170 | 445189 | AGGGATGGCCAGGAAGGACA | 96 | 2240 |
| 1041827 | N/A | N/A | 445492 | 445511 | ATCAGAAAACCCCGTCTCAA | 104 | 2241 |
| 1041859 | N/A | N/A | 445770 | 445789 | TCCCTGTTTTCACAAATTGC | 68 | 2242 |
| 1041891 | N/A | N/A | 445980 | 445999 | TTCAATAAAATTCCTTTCAC | 93 | 2243 |
| 1041923 | N/A | N/A | 446357 | 446376 | ATGGCCTTTATACTTTTGTA | 116 | 2244 |
| 1041955 | N/A | N/A | 446849 | 446868 | ACACATTTTCCAGAATGGTT | 16 | 2245 |
| 1041987 | N/A | N/A | 447638 | 447657 | CTTTTTTATTTACTTGTATA | 80 | 2246 |
| 1042019 | N/A | N/A | 448386 | 448405 | CACTGTCCTTTTCAGAGAGA | 68 | 2247 |
| 1042051 | N/A | N/A | 448682 | 448701 | CTTACATCACAAACATCCCA | 95 | 2248 |
| 1042083 | N/A | N/A | 449050 | 449069 | CTAATGATACATTTCAGGCT | 46 | 2249 |
| 1042115 | N/A | N/A | 449593 | 449612 | ATATATATCATCAAATCTGT | 23 | 2250 |
| 1042147 | N/A | N/A | 449862 | 449881 | CTCCTCACTAATTAGTGTGA | 110 | 2251 |
| 1042179 | N/A | N/A | 450507 | 450526 | GCCTGCCGAAAAATTCACGA | 144 | 2252 |
| 1042211 | N/A | N/A | 451139 | 451158 | CCAACCAGCCTAAAAAATTG | 122 | 2253 |
| 1042243 | N/A | N/A | 451540 | 451559 | TAGGATAATTTTATGGCACC | 8 | 2254 |
| 1042275 | N/A | N/A | 451908 | 451927 | CAGGCAATATTTAATTTTCT | 11 | 2255 |
| 1042307 | N/A | N/A | 452186 | 452205 | TTGCTGCAAATCCAAGTCAT | 34 | 2256 |
| 1042339 | N/A | N/A | 452466 | 452485 | TGCCTTATAGCCACTCATAC | 33 | 2257 |
| 1042371 | N/A | N/A | 452978 | 452997 | TGAGTACATTCATATGGCAG | 13 | 2258 |
| 1042403 | N/A | N/A | 453760 | 453779 | TGGCGAATTCTATATGGAGC | 63 | 2259 |

TABLE 30-continued

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1042435 | N/A | N/A | 454638 | 454657 | AGTTGAATAGACATGGATTA | 73 | 2260 |
| 1042467 | N/A | N/A | 455281 | 455300 | ACTTTCACAATTTTGCAAAT | 45 | 2261 |
| 1042499 | N/A | N/A | 456211 | 456230 | TCTGAACAAAAATATAAGCA | 106 | 2262 |
| 1042531 | N/A | N/A | 456890 | 456909 | AAGGTCATCAATATTCAAAA | 19 | 2263 |

TABLE 31

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 3 | 138 |
| 1040100 | 2215 | 2234 | 436934 | 436953 | AGGCTTCCCTAAATGCAGGC | 69 | 2264 |
| 1040132 | 3098 | 3117 | 457351 | 457370 | GGCCGTCGGCCTTTGAGTGC | 106 | 2265 |
| 1040164 | 3838 | 3857 | 458091 | 458110 | AGGCAGAGAAAAAGAGACCC | 72 | 2266 |
| 1040196 | 4421 | 4440 | 458674 | 458693 | AGTCATGAACTATAAACAGT | 34 | 2267 |
| 1040228 | 4736 | 4755 | 458989 | 459008 | ATAATTCACATTCATCCCTT | 28 | 2268 |
| 1040260 | 5084 | 5103 | 459337 | 459356 | AACATAACCTTATAAAATGG | 82 | 2269 |
| 1040292 | 5447 | 5466 | 459700 | 459719 | TTCTCCCTACTTATAAAACT | 48 | 2270 |
| 1040324 | 5798 | 5817 | 460051 | 460070 | CGTTTAAAAAATACAGCACT | 49 | 2271 |
| 1040356 | 6228 | 6247 | 460481 | 460500 | GCTTTAACTATATAGCACAC | 78 | 2272 |
| 1040388 | 6995 | 7014 | 461248 | 461267 | GCCTGCTGTTACTAGTTTAA | 31 | 2273 |
| 1040420 | 7415 | 7434 | 461668 | 461687 | AACACACTCACCTAACGAAA | 47 | 2274 |
| 1040452 | 7920 | 7939 | 462173 | 462192 | CTCTGCTTCCTCACCCATAT | 36 | 2275 |
| 1040484 | 8251 | 8270 | 462504 | 462523 | TGCTTTATAAAAAAGTATAT | 128 | 2276 |
| 1040516 | 8606 | 8625 | 462859 | 462878 | TTCAACAGAGCCATATCTTT | 65 | 2277 |
| 1040548 | 8989 | 9008 | 463242 | 463261 | GTGTTCAAGATTATATTCTT | 40 | 2278 |
| 1040580 | 9344 | 9363 | 463597 | 463616 | GTTAGCTACCAGAACAGTTG | 40 | 2279 |
| 1040612 | 9667 | 9686 | 463920 | 463939 | GTAAGGATTACTGTAAACAA | 12 | 2280 |
| 1040644 | 10208 | 10227 | 464461 | 464480 | CAAAACATCATTCCTTCCCT | 84 | 2281 |
| 1040676 | 10419 | 10438 | 464672 | 464691 | CGAGTGTATCCTACAAATAG | 56 | 2282 |
| 1040708 | N/A | N/A | 11914 | 11933 | TGCCAGAGAATTTATATGTA | 10 | 2283 |
| 1040740 | N/A | N/A | 27352 | 27371 | CCTGTCAAAACCAGTCACTC | 60 | 2284 |
| 1040772 | N/A | N/A | 41515 | 41534 | CTAATAATAGTCTAATTACA | 134 | 2285 |
| 1040804 | N/A | N/A | 71673 | 71692 | TTGTGCTTTTAAATTCAAAC | 10 | 2286 |
| 1040836 | N/A | N/A | 87528 | 87547 | ACATCCTTTTAAATGTTAGG | 31 | 2287 |

TABLE 31-continued

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040868 | N/A | N/A | 109301 | 109320 | TGTCTTAATCAAACCTCCCG | 50 | 2288 |
| 1040900 | N/A | N/A | 141437 | 141456 | CAGTTCTATTTTTAGTTATA | 10 | 2289 |
| 1040932 | N/A | N/A | 168436 | 168455 | ATTTACCTTCTTTAACACAA | 66 | 2290 |
| 1040964 | N/A | N/A | 188787 | 188806 | GGGATATTTTAAAATTCTAC | 54 | 2291 |
| 1040996 | N/A | N/A | 208934 | 208953 | CCTGGGTTTCAAAGATTCCT | 100 | 2292 |
| 1041028 | N/A | N/A | 229640 | 229659 | TAGAGAATTCAAAGCACCAA | 46 | 2293 |
| 1041060 | N/A | N/A | 253001 | 253020 | TCAAAGTTTTAAAGAGTTTT | 88 | 2294 |
| 1041092 | N/A | N/A | 271090 | 271109 | TGCTCCAAACCCAGCTCCTC | 132 | 2295 |
| 1041124 | N/A | N/A | 288911 | 288930 | CCCTACTCCTTTTATAGATG | 32 | 2296 |
| 1041156 | N/A | N/A | 319014 | 319033 | TCATCCAAACCCAGACGGGT | 120 | 2297 |
| 1041188 | N/A | N/A | 339984 | 340003 | ATAAAGTCCTTTTAACCCCT | 4 | 2298 |
| 1041220 | N/A | N/A | 367208 | 367227 | GTGCCCTTTTAAAATCTTTT | 6 | 2299 |
| 1041252 | N/A | N/A | 386698 | 386717 | AGCCAAAAATACATCCACCT | 24 | 2300 |
| 1041284 | N/A | N/A | 413882 | 413901 | ACTGTAATCTAAACAGGCAA | 87 | 2301 |
| 1041316 | N/A | N/A | 437786 | 437805 | TTCATTACACACAGCAGAGA | 26 | 2302 |
| 1041348 | N/A | N/A | 438225 | 438244 | AGACATTATATATATGTTGG | 27 | 2303 |
| 1041380 | N/A | N/A | 438512 | 438531 | CCCCTACACCCCAGAGCACA | 109 | 2304 |
| 1041412 | N/A | N/A | 439104 | 439123 | GATTGTATTAACCACGCTTT | 18 | 2305 |
| 1041444 | N/A | N/A | 439457 | 439476 | TGAATGTCCCAAATAGCAGC | 34 | 2306 |
| 1041476 | N/A | N/A | 440138 | 440157 | CACCCCTAATTCATGCAGGA | 72 | 2307 |
| 1041508 | N/A | N/A | 440361 | 440380 | GCCTTCATTCTCAAGCTGAA | 43 | 2308 |
| 1041540 | N/A | N/A | 441162 | 441181 | TTTAGCTGTGATGATGTCAG | 51 | 2309 |
| 1041572 | N/A | N/A | 441556 | 441575 | TCAGGCATCCTCAAGAGTCT | 68 | 2310 |
| 1041604 | N/A | N/A | 442235 | 442254 | CTTTAGTTCCCATGAGGTCT | 41 | 2311 |
| 1041636 | N/A | N/A | 442680 | 442699 | AAGTGGATTATATTTGGCAG | 7 | 2312 |
| 1041668 | N/A | N/A | 443031 | 443050 | ATCAGCTGCCTCTCCTTCCA | 47 | 2313 |
| 1041700 | N/A | N/A | 443489 | 443508 | CCAATACATTTTACAACTCC | 57 | 2314 |
| 1041732 | N/A | N/A | 443874 | 443893 | GGACTGACTCTACAGGCTCA | 41 | 2315 |
| 1041764 | N/A | N/A | 444260 | 444279 | ACTGCTTTAAACAATAGTCT | 65 | 2316 |
| 1041796 | N/A | N/A | 445235 | 445254 | TTTTTCTTACACATGGTAGC | 28 | 2317 |
| 1041828 | N/A | N/A | 445506 | 445525 | TCAGCATGAAAAAAATCAGA | 76 | 2318 |
| 1041860 | N/A | N/A | 445772 | 445791 | AGTCCCTGTTTTCACAAATT | 45 | 2319 |
| 1041892 | N/A | N/A | 446016 | 446035 | GCTTTAAGAAAAATTTTAG | 123 | 2320 |
| 1041924 | N/A | N/A | 446359 | 446378 | GGATGGCCTTTATACTTTTG | 52 | 2321 |
| 1041956 | N/A | N/A | 446875 | 446894 | TCATTTTATGATCTTGCTGG | 25 | 2322 |
| 1041988 | N/A | N/A | 447659 | 447678 | CTGGTTATCTTCTTATGCAT | 89 | 2323 |

TABLE 31-continued

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1042020 | N/A | N/A | 448422 | 448441 | TTTGGAATCTTTTTTGCCTC | 44 | 2324 |
| 1042052 | N/A | N/A | 448684 | 448703 | CTCTTACATCACAAACATCC | 102 | 2325 |
| 1042084 | N/A | N/A | 449054 | 449073 | GTTCCTAATGATACATTTCA | 52 | 2326 |
| 1042116 | N/A | N/A | 449594 | 449613 | AATATATATCATCAAATCTG | 46 | 2327 |
| 1042148 | N/A | N/A | 449866 | 449885 | TTTTCTCCTCACTAATTAGT | 112 | 2328 |
| 1042180 | N/A | N/A | 450508 | 450527 | AGCCTGCCGAAAAATTCACG | 116 | 2329 |
| 1042212 | N/A | N/A | 451152 | 451171 | CCATAAAAACCCTCCAACCA | 112 | 2330 |
| 1042244 | N/A | N/A | 451541 | 451560 | CTAGGATAATTTTATGGCAC | 9 | 2331 |
| 1042276 | N/A | N/A | 451909 | 451928 | GCAGGCAATATTTAATTTTC | 37 | 2332 |
| 1042308 | N/A | N/A | 452218 | 452237 | GGAAACCAATCCCACATCAA | 78 | 2333 |
| 1042340 | N/A | N/A | 452472 | 452491 | AGTGTTTGCCTTATAGCCAC | 20 | 2334 |
| 1042372 | N/A | N/A | 452979 | 452998 | TTGAGTACATTCATATGGCA | 30 | 2335 |
| 1042404 | N/A | N/A | 453783 | 453802 | TGCTAAAGAAAAGAATTGT | 111 | 2336 |
| 1042436 | N/A | N/A | 454643 | 454662 | TTTCCAGTTGAATAGACATG | 62 | 2337 |
| 1042468 | N/A | N/A | 455285 | 455304 | AATTACTTTCACAATTTTGC | 27 | 2338 |
| 1042500 | N/A | N/A | 456212 | 456231 | CTCTGAACAAAAATATAAGC | 87 | 2339 |
| 1042532 | N/A | N/A | 456957 | 456976 | ACACACTATAAATGAGGCTC | 46 | 2340 |

TABLE 32

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 3 | 138 |
| 1040101 | 2216 | 2235 | 436935 | 436954 | CAGGCTTCCCTAAATGCAGG | 70 | 2341 |
| 1040133 | 3109 | 3128 | 457362 | 457381 | GCTGCCCGCCAGGCCGTCGG | 111 | 2342 |
| 1040165 | 3880 | 3899 | 458133 | 458152 | CCCCCCCGGCCCATGCCGAT | 108 | 2343 |
| 1040197 | 4422 | 4441 | 458675 | 458694 | TAGTCATGAACTATAAACAG | 46 | 2344 |
| 1040229 | 4738 | 4757 | 458991 | 459010 | TCATAATTCACATTCATCCC | 16 | 2345 |
| 1040261 | 5106 | 5125 | 459359 | 459378 | GACCAAAATGAATTTTCAAA | 26 | 2346 |
| 1040293 | 5458 | 5477 | 459711 | 459730 | TATTTAAAAATTTCTCCCTA | 95 | 2347 |
| 1040325 | 5902 | 5921 | 460155 | 460174 | TCTTACCATCAAAGGCTAAA | 60 | 2348 |
| 1040357 | 6229 | 6248 | 460482 | 460501 | AGCTTTAACTATATAGCACA | 107 | 2349 |
| 1040389 | 7040 | 7059 | 461293 | 461312 | CCTGACTAATTTCTTGGTGA | 46 | 2350 |
| 1040421 | 7422 | 7441 | 461675 | 461694 | AAAACCCAACACACTCACCT | 116 | 2351 |
| 1040453 | 7964 | 7983 | 462217 | 462236 | GACAACCAACACAGCTCAAG | 83 | 2352 |

TABLE 32-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040485 | 8252 | 8271 | 462505 | 462524 | GTGCTTTATAAAAAGTATA | 94 | 2353 |
| 1040517 | 8613 | 8632 | 462866 | 462885 | TCATTGTTTCAACAGAGCCA | 12 | 2354 |
| 1040549 | 8990 | 9009 | 463243 | 463262 | CGTGTTCAAGATTATATTCT | 49 | 2355 |
| 1040581 | 9345 | 9364 | 463598 | 463617 | AGTTAGCTACCAGAACAGTT | 52 | 2356 |
| 1040613 | 9711 | 9730 | 463964 | 463983 | TGTCACCTAATACTTGGTAT | 25 | 2357 |
| 1040645 | 10211 | 10230 | 464464 | 464483 | GTGCAAAACATCATTCCTTC | 10 | 2358 |
| 1040677 | 10436 | 10455 | 464689 | 464708 | AATTCAATAAACAGACTCGA | 40 | 2359 |
| 1040709 | N/A | N/A | 12342 | 12361 | TTCAGAATTTAAAATTCAGC | 15 | 2360 |
| 1040741 | N/A | N/A | 27434 | 27453 | ACAATTAGCCAAAACTGAAT | 45 | 2361 |
| 1040773 | N/A | N/A | 42923 | 42942 | CGTTCCAAATTATTCCTGCT | 7 | 2362 |
| 1040805 | N/A | N/A | 72788 | 72807 | ATTTGCTCCTTTTATCATTG | 7 | 2363 |
| 1040837 | N/A | N/A | 87598 | 87617 | ACATTATTTCAAAACCCACA | 49 | 2364 |
| 1040869 | N/A | N/A | 110925 | 110944 | TAGTGGTTAGATTAACAGCT | 6 | 2365 |
| 1040901 | N/A | N/A | 141588 | 141607 | GTCTCATAACGATAACCAAA | 23 | 2366 |
| 1040933 | N/A | N/A | 169799 | 169818 | ACCTTTAAAATTTTTTCAGC | 94 | 2367 |
| 1040965 | N/A | N/A | 189270 | 189289 | GCTTACAAAGCCATAGAACC | 67 | 2368 |
| 1040997 | N/A | N/A | 209089 | 209108 | GTCTACAGCCTTTAACGACT | 85 | 2369 |
| 1041029 | N/A | N/A | 229753 | 229772 | CCAGTTAACCAAAAAATTTT | 119 | 2370 |
| 1041061 | N/A | N/A | 255397 | 255416 | GGCTACTATCAAATACATTT | 9 | 2371 |
| 1041093 | N/A | N/A | 271117 | 271136 | TGTTTATTTCAAACTTTCCC | 55 | 2372 |
| 1041125 | N/A | N/A | 289433 | 289452 | GGTCTTGGCCCTTAACTGTT | 20 | 2373 |
| 1041157 | N/A | N/A | 319225 | 319244 | CCCTGATAAATTTATGAATT | 50 | 2374 |
| 1041189 | N/A | N/A | 341174 | 341193 | TTTGATCTGCCTTATCTCTG | 14 | 2375 |
| 1041221 | N/A | N/A | 367501 | 367520 | TTTGTATTTTAAACTGAGTG | 5 | 2376 |
| 1041253 | N/A | N/A | 386699 | 386718 | AAGCCAAAAATACATCCACC | 46 | 2377 |
| 1041285 | N/A | N/A | 414009 | 414028 | CTTTTTAGAATACCATGCCC | 95 | 2378 |
| 1041317 | N/A | N/A | 437788 | 437807 | AATTCATTACACACAGCAGA | 8 | 2379 |
| 1041349 | N/A | N/A | 438226 | 438245 | AAGACATTATATATATGTTG | 89 | 2380 |
| 1041381 | N/A | N/A | 438520 | 438539 | AAGGACAGCCCCTACACCCC | 97 | 2381 |
| 1041413 | N/A | N/A | 439106 | 439125 | CAGATTGTATTAACCACGCT | 5 | 2382 |
| 1041445 | N/A | N/A | 439471 | 439490 | TGTTTTATTTTATCTGAATG | 61 | 2383 |
| 1041477 | N/A | N/A | 440139 | 440158 | CCACCCCTAATTCATGCAGG | 67 | 2384 |
| 1041509 | N/A | N/A | 440364 | 440383 | GCTGCCTTCATTCTCAAGCT | 81 | 2385 |
| 1041541 | N/A | N/A | 441172 | 441191 | GGTGGAGTATTTAGCTGTG | 10 | 2386 |
| 1041573 | N/A | N/A | 441564 | 441583 | TTATGAGTTCAGGCATCCTC | 15 | 2387 |
| 1041605 | N/A | N/A | 442237 | 442256 | GGCTTTAGTTCCCATGAGGT | 20 | 2388 |

TABLE 32-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041637 | N/A | N/A | 442682 | 442701 | TTAAGTGGATTATATTTGGC | 11 | 2389 |
| 1041669 | N/A | N/A | 443041 | 443060 | CTAGACTTTCATCAGCTGCC | 53 | 2390 |
| 1041701 | N/A | N/A | 443490 | 443509 | ACCAATACATTTTACAACTC | 34 | 2391 |
| 1041733 | N/A | N/A | 443877 | 443896 | AAGGGACTGACTCTACAGGC | 16 | 2392 |
| 1041765 | N/A | N/A | 444289 | 444308 | GACCTCTCTCTACTTGCTGT | 30 | 2393 |
| 1041797 | N/A | N/A | 445239 | 445258 | TGGGTTTTTCTTACACATGG | 9 | 2394 |
| 1041829 | N/A | N/A | 445574 | 445593 | GTCTTGTTTTACCTGTAGAG | 6 | 2395 |
| 1041861 | N/A | N/A | 445787 | 445806 | CATTTCCTTCACAAGAGTCC | 78 | 2396 |
| 1041893 | N/A | N/A | 446036 | 446055 | CCTAATCTGACTAATGACTG | 94 | 2397 |
| 1041925 | N/A | N/A | 446361 | 446380 | AGGGATGGCCTTTATACTTT | 46 | 2398 |
| 1041957 | N/A | N/A | 446885 | 446904 | AATCATTAAGTCATTTTATG | 79 | 2399 |
| 1041989 | N/A | N/A | 447660 | 447679 | ACTGGTTATCTTCTTATGCA | 120 | 2400 |
| 1042021 | N/A | N/A | 448436 | 448455 | ACTCTCTCCATTCATTTGGA | 52 | 2401 |
| 1042053 | N/A | N/A | 448685 | 448704 | TCTCTTACATCACAAACATC | 94 | 2402 |
| 1042085 | N/A | N/A | 449059 | 449078 | TGAGGGTTCCTAATGATACA | 41 | 2403 |
| 1042117 | N/A | N/A | 449599 | 449618 | GTGAGAATATATATCATCAA | 100 | 2404 |
| 1042149 | N/A | N/A | 449885 | 449904 | CTTGCCAGCCCAATGCTAGT | 95 | 2405 |
| 1042181 | N/A | N/A | 450520 | 450539 | CATAGCTAGAACAGCCTGCC | 107 | 2406 |
| 1042213 | N/A | N/A | 451153 | 451172 | CCCATAAAAACCCTCCAACC | 102 | 2407 |
| 1042245 | N/A | N/A | 451542 | 451561 | GCTAGGATAATTTTATGGCA | 40 | 2408 |
| 1042277 | N/A | N/A | 451926 | 451945 | TATACACACTTCACAGGGCA | 56 | 2409 |
| 1042309 | N/A | N/A | 452223 | 452242 | CAGAAGGAAACCAATCCCAC | 80 | 2410 |
| 1042341 | N/A | N/A | 452473 | 452492 | CAGTGTTTGCCTTATAGCCA | 11 | 2411 |
| 1042373 | N/A | N/A | 452982 | 453001 | AACTTGAGTACATTCATATG | 72 | 2412 |
| 1042405 | N/A | N/A | 453799 | 453818 | TGGAATATCTTTACAGTGCT | 38 | 2413 |
| 1042437 | N/A | N/A | 454668 | 454687 | CACTGAAATCAAGAATGCAA | 81 | 2414 |
| 1042469 | N/A | N/A | 455287 | 455306 | TGAATTACTTTCACAATTTT | 73 | 2415 |
| 1042501 | N/A | N/A | 456214 | 456233 | AACTCTGAACAAAAATATAA | 151 | 2416 |
| 1042533 | N/A | N/A | 456961 | 456980 | AGCCACACACTATAAATGAG | 99 | 2417 |

TABLE 33

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 3 | 138 |
| 1040102 | 2217 | 2236 | 436936 | 436955 | CCAGGCTTCCCTAAATGCAG | 92 | 2418 |
| 1040134 | 3141 | 3160 | 457394 | 457413 | ATTCCGTTTTCCTGCTCGGC | 32 | 2419 |
| 1040166 | 3890 | 3909 | 458143 | 458162 | CTGCTCTGAACCCCCCCGGC | 100 | 2420 |
| 1040198 | 4429 | 4448 | 458682 | 458701 | TTGTCCATAGTCATGAACTA | 78 | 2421 |
| 1040230 | 4739 | 4758 | 458992 | 459011 | TTCATAATTCACATTCATCC | 10 | 2422 |
| 1040262 | 5119 | 5138 | 459372 | 459391 | GATGTGGTAAAAGACCAAA | 38 | 2423 |
| 1040294 | 5459 | 5478 | 459712 | 459731 | ATATTTAAAAATTTCTCCCT | 90 | 2424 |
| 1040326 | 5904 | 5923 | 460157 | 460176 | CCTCTTACCATCAAAGGCTA | 57 | 2425 |
| 1040358 | 6230 | 6249 | 460483 | 460502 | GAGCTTTAACTATATAGCAC | 44 | 2426 |
| 1040390 | 7045 | 7064 | 461298 | 461317 | TTCGCCCTGACTAATTTCTT | 25 | 2427 |
| 1040422 | 7450 | 7469 | 461703 | 461722 | GGATGCTGCCACTTCCTGGT | 66 | 2428 |
| 1040454 | 7968 | 7987 | 462221 | 462240 | CCATGACAACCAACACAGCT | 131 | 2429 |
| 1040486 | 8278 | 8297 | 462531 | 462550 | CCAACCCAACACAATAGCAG | 33 | 2430 |
| 1040518 | 8615 | 8634 | 462868 | 462887 | ACTCATTGTTTCAACAGAGC | 27 | 2431 |
| 1040550 | 9008 | 9027 | 463261 | 463280 | CCCTTGTTACAAACACTTCG | 65 | 2432 |
| 1040582 | 9369 | 9388 | 463622 | 463641 | CCCTCCCGCCATTACACAGG | 83 | 2433 |
| 1040614 | 9714 | 9733 | 463967 | 463986 | TAGTGTCACCTAATACTTGG | 59 | 2434 |
| 1040646 | 10212 | 10231 | 464465 | 464484 | GGTGCAAAACATCATTCCTT | 21 | 2435 |
| 1040678 | 10442 | 10461 | 464695 | 464714 | CCATAAAATTCAATAAACAG | 108 | 2436 |
| 1040710 | N/A | N/A | 13427 | 13446 | ATAAGCTTTCTTTAAATGCA | 9 | 2437 |
| 1040742 | N/A | N/A | 27656 | 27675 | GTGTTCTTTCTTTAACAGTT | 4 | 2438 |
| 1040774 | N/A | N/A | 42927 | 42946 | CCCCCGTTCCAAATTATTCC | 106 | 2439 |
| 1040806 | N/A | N/A | 74008 | 74027 | GTTTTTATCCATTACAAGAG | 22 | 2440 |
| 1040838 | N/A | N/A | 88730 | 88749 | ACCCGCAATCAAATACTGCC | 73 | 2441 |
| 1040870 | N/A | N/A | 111213 | 111232 | CTAATGTGCCCTTAACATGG | 95 | 2442 |
| 1040902 | N/A | N/A | 141663 | 141682 | GCTCATAAAACCATGTGCTC | 100 | 2443 |
| 1040934 | N/A | N/A | 170327 | 170346 | GCTTGATTTTAAACTTTATA | 40 | 2444 |
| 1040966 | N/A | N/A | 190544 | 190563 | ACCCTCAAACGAATAGGCTC | 145 | 2445 |
| 1040998 | N/A | N/A | 209796 | 209815 | TCCACACAAGAATAATCTAC | 86 | 2446 |
| 1041030 | N/A | N/A | 230401 | 230420 | GCTAGGAAAATTTACCATAC | 29 | 2447 |
| 1041062 | N/A | N/A | 255626 | 255645 | GATTAAATAATTTAAGCACA | 110 | 2448 |
| 1041094 | N/A | N/A | 271334 | 271353 | TCTTGGGTTCCTTATATTAC | 56 | 2449 |
| 1041126 | N/A | N/A | 290352 | 290371 | TAGGTGTTTATTTAGAACCC | 12 | 2450 |
| 1041158 | N/A | N/A | 319445 | 319464 | TCATGCTTTCAAAACACAGT | 11 | 2451 |
| 1041190 | N/A | N/A | 342628 | 342647 | AATGAAATCATTTACTGAAC | 85 | 2452 |

TABLE 33-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041222 | N/A | N/A | 368463 | 368482 | AGTGTAATACATTACTCATA | 5 | 2453 |
| 1041254 | N/A | N/A | 387051 | 387070 | GTATACAAAGATATAACCTG | 76 | 2454 |
| 1041286 | N/A | N/A | 418439 | 418458 | TGTTTGTTTTAAAATTAGGG | 72 | 2455 |
| 1041318 | N/A | N/A | 437792 | 437811 | GGTTAATTCATTACACACAG | 3 | 2456 |
| 1041350 | N/A | N/A | 438237 | 438256 | ACCTAAATAATAAGACATTA | 141 | 2457 |
| 1041382 | N/A | N/A | 438532 | 438551 | AGCCAGACAACTAAGGACAG | 80 | 2458 |
| 1041414 | N/A | N/A | 439107 | 439126 | TCAGATTGTATTAACCACGC | 5 | 2459 |
| 1041446 | N/A | N/A | 439472 | 439491 | TTGTTTTATTTTATCTGAAT | 95 | 2460 |
| 1041478 | N/A | N/A | 440143 | 440162 | GTACCCACCCCTAATTCATG | 119 | 2461 |
| 1041510 | N/A | N/A | 440366 | 440385 | TGGCTGCCTTCATTCTCAAG | 106 | 2462 |
| 1041542 | N/A | N/A | 441188 | 441207 | TGTGGCAAACACAGCTGGTG | 45 | 2463 |
| 1041574 | N/A | N/A | 441611 | 441630 | ATACTATATCACACTGCTTT | 58 | 2464 |
| 1041606 | N/A | N/A | 442251 | 442270 | GTTTTATATGCCATGGCTTT | 58 | 2465 |
| 1041638 | N/A | N/A | 442691 | 442710 | TGGAGGATATTAAGTGGATT | 22 | 2466 |
| 1041670 | N/A | N/A | 443042 | 443061 | TCTAGACTTTCATCAGCTGC | 66 | 2467 |
| 1041702 | N/A | N/A | 443492 | 443511 | TTACCAATACATTTTACAAC | 72 | 2468 |
| 1041734 | N/A | N/A | 443917 | 443936 | GGCATGTTCAATGTTGGCAA | 16 | 2469 |
| 1041766 | N/A | N/A | 444314 | 444333 | ACAGGGAAAACTGTTAGGTG | 7 | 2470 |
| 1041798 | N/A | N/A | 445240 | 445259 | CTGGGTTTTCTTACACATG | 10 | 2471 |
| 1041830 | N/A | N/A | 445576 | 445595 | CAGTCTTGTTTTACCTGTAG | 6 | 2472 |
| 1041862 | N/A | N/A | 445791 | 445810 | CTCCCATTTCCTTCACAAGA | 53 | 2473 |
| 1041894 | N/A | N/A | 446044 | 446063 | GTCACCTTCCTAATCTGACT | 106 | 2474 |
| 1041926 | N/A | N/A | 446679 | 446698 | CCTTTATAACTTTTCTTTCT | 28 | 2475 |
| 1041958 | N/A | N/A | 446891 | 446910 | GTTAGTAATCATTAAGTCAT | 5 | 2476 |
| 1041990 | N/A | N/A | 447677 | 447696 | CCCTGGTGCCAAAAGGGACT | 100 | 2477 |
| 1042022 | N/A | N/A | 448475 | 448494 | TCTTTAACCCCTCTTGCGCC | 123 | 2478 |
| 1042054 | N/A | N/A | 448687 | 448706 | TTTCTCTTACATCACAAACA | 116 | 2479 |
| 1042086 | N/A | N/A | 449060 | 449079 | TTGAGGGTTCCTAATGATAC | 54 | 2480 |
| 1042118 | N/A | N/A | 449600 | 449619 | AGTGAGAATATATATCATCA | 122 | 2481 |
| 1042150 | N/A | N/A | 449916 | 449935 | AATCTGATCATTGTAGGCAC | 12 | 2482 |
| 1042182 | N/A | N/A | 450530 | 450549 | TGGTGTGAACCATAGCTAGA | 120 | 2483 |
| 1042214 | N/A | N/A | 451161 | 451180 | ACCCCCCTCCCATAAAAACC | 117 | 2484 |
| 1042246 | N/A | N/A | 451566 | 451585 | GGTTTTACCCTTTCCTGCAC | 90 | 2485 |
| 1042278 | N/A | N/A | 451931 | 451950 | CACATTATACACACTTCACA | 78 | 2486 |
| 1042310 | N/A | N/A | 452244 | 452263 | TCATTAACAACATAAACTGA | 74 | 2487 |
| 1042342 | N/A | N/A | 452495 | 452514 | CATGGTACAGATAATTGTGA | 57 | 2488 |

TABLE 33-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1042374 | N/A | N/A | 453018 | 453037 | TACTGGATCCATACAAGGCA | 33 | 2489 |
| 1042406 | N/A | N/A | 453800 | 453819 | ATGGAATATCTTTACAGTGC | 17 | 2490 |
| 1042438 | N/A | N/A | 454669 | 454688 | CCACTGAAATCAAGAATGCA | 121 | 2491 |
| 1042470 | N/A | N/A | 455290 | 455309 | TCTTGAATTACTTTCACAAT | 24 | 2492 |
| 1042502 | N/A | N/A | 456227 | 456246 | GAGGACAACTAAAAACTCTG | 105 | 2493 |
| 1042534 | N/A | N/A | 456962 | 456981 | CAGCCACACACTATAAATGA | 112 | 2494 |

TABLE 34

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 2 | 138 |
| 1040103 | 2218 | 2237 | 436937 | 436956 | GCCAGGCTTCCCTAAATGCA | 135 | 2495 |
| 1040135 | 3180 | 3199 | 457433 | 457452 | TCGCCATTCTCAGAGAGCAT | 79 | 2496 |
| 1040167 | 3909 | 3928 | 458162 | 458181 | TGGGAACCCCAGGAGGACAC | 54 | 2497 |
| 1040199 | 4484 | 4503 | 458737 | 458756 | ATCTAATTCCTCATGTCACA | 15 | 2498 |
| 1040231 | 4740 | 4759 | 458993 | 459012 | GTTCATAATTCACATTCATC | 8 | 2499 |
| 1040263 | 5161 | 5180 | 459414 | 459433 | CAGAGTTTCTAAGAGCCCGC | 38 | 2500 |
| 1040295 | 5460 | 5479 | 459713 | 459732 | AATATTTAAAAATTTCTCCC | 110 | 2501 |
| 1040327 | 5906 | 5925 | 460159 | 460178 | TTCCTCTTACCATCAAAGGC | 38 | 2502 |
| 1040359 | 6232 | 6251 | 460485 | 460504 | ATGAGCTTTAACTATATAGC | 31 | 2503 |
| 1040391 | 7049 | 7068 | 461302 | 461321 | TCTTTTCGCCCTGACTAATT | 32 | 2504 |
| 1040423 | 7495 | 7514 | 461748 | 461767 | AAGAGGTGTGAAAGGTTCCG | 27 | 2505 |
| 1040455 | 7969 | 7988 | 462222 | 462241 | GCCATGACAACCAACACAGC | 96 | 2506 |
| 1040487 | 8283 | 8302 | 462536 | 462555 | GGAAACCAACCCAACACAAT | 73 | 2507 |
| 1040519 | 8662 | 8681 | 462915 | 462934 | ACTTTCAACCCTTCTCTGCT | 53 | 2508 |
| 1040551 | 9010 | 9029 | 463263 | 463282 | ATCCCTTGTTACAAACACTT | 33 | 2509 |
| 1040583 | 9370 | 9389 | 463623 | 463642 | TCCCTCCCGCCATTACACAG | 94 | 2510 |
| 1040615 | 9719 | 9738 | 463972 | 463991 | TGAGCTAGTGTCACCTAATA | 12 | 2511 |
| 1040647 | 10213 | 10232 | 464466 | 464485 | AGGTGCAAAACATCATTCCT | 36 | 2512 |
| 1040679 | 10447 | 10466 | 464700 | 464719 | AGGGACCATAAAATTCAATA | 22 | 2513 |
| 1040711 | N/A | N/A | 14141 | 14160 | CTCCTCCAAATTTATCTTCA | 56 | 2514 |
| 1040743 | N/A | N/A | 28302 | 28321 | CACAAAATACATTAAGTCCT | 27 | 2515 |
| 1040775 | N/A | N/A | 43117 | 43136 | TCCAGCAAAATATTTCTTTA | 39 | 2516 |
| 1040807 | N/A | N/A | 74082 | 74101 | TTGATCAACCAAAGATGGCT | 39 | 2517 |

TABLE 34-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040839 | N/A | N/A | 88777 | 88796 | CCAATGGCTTTTTAACAGAT | 27 | 2518 |
| 1040871 | N/A | N/A | 112988 | 113007 | AACACATTAGATTATGAGTA | 11 | 2519 |
| 1040903 | N/A | N/A | 141741 | 141760 | AGGGTGTTATTTTAGAGTAA | 13 | 2520 |
| 1040935 | N/A | N/A | 171157 | 171176 | GCTGGAAAAGAATCTGAGCA | 114 | 2521 |
| 1040967 | N/A | N/A | 190616 | 190635 | GTTATATTATTTTATCCCTT | 14 | 2522 |
| 1040999 | N/A | N/A | 209931 | 209950 | GAAGATATCTTTTATGACAC | 23 | 2523 |
| 1041031 | N/A | N/A | 231711 | 231730 | CACAGTAGCCAAAAGCAGTC | 95 | 2524 |
| 1041063 | N/A | N/A | 255652 | 255671 | GTATATATTATTTAAAATGT | 101 | 2525 |
| 1041095 | N/A | N/A | 273041 | 273060 | AGCTGGTTTCTTTAGCCACC | 81 | 2526 |
| 1041127 | N/A | N/A | 290740 | 290759 | GACTGAAAAATACCCAGCCA | 102 | 2527 |
| 1041159 | N/A | N/A | 322660 | 322679 | TAGGCCTTATTTTATTCCAT | 72 | 2528 |
| 1041191 | N/A | N/A | 342814 | 342833 | TGAGCTTTTTAAAAACAGTT | 4 | 2529 |
| 1041223 | N/A | N/A | 369251 | 369270 | TTTCTTAGCCAAAGAGATAT | 85 | 2530 |
| 1041255 | N/A | N/A | 387144 | 387163 | TGTTCAATTTAAAAGCCTTG | 5 | 2531 |
| 1041287 | N/A | N/A | 418795 | 418814 | ATCTGCAAAGAATCTGCCCC | 72 | 2532 |
| 1041319 | N/A | N/A | 437793 | 437812 | AGGTTAATTCATTACACACA | 5 | 2533 |
| 1041351 | N/A | N/A | 438241 | 438260 | TCATACCTAAATAATAAGAC | 102 | 2534 |
| 1041383 | N/A | N/A | 438533 | 438552 | CAGCCAGACAACTAAGGACA | 57 | 2535 |
| 1041415 | N/A | N/A | 439116 | 439135 | CCTGACTTCTCAGATTGTAT | 50 | 2536 |
| 1041447 | N/A | N/A | 439505 | 439524 | ATTCAAACCATTAATTAGTT | 73 | 2537 |
| 1041479 | N/A | N/A | 440144 | 440163 | AGTACCCACCCCTAATTCAT | 98 | 2538 |
| 1041511 | N/A | N/A | 440368 | 440387 | AGTGGCTGCCTTCATTCTCA | 52 | 2539 |
| 1041543 | N/A | N/A | 441206 | 441225 | GACTCTGAACCTGTCACTTG | 83 | 2540 |
| 1041575 | N/A | N/A | 441613 | 441632 | CCATACTATATCACACTGCT | 21 | 2541 |
| 1041607 | N/A | N/A | 442255 | 442274 | CTCAGTTTTATATGCCATGG | 44 | 2542 |
| 1041639 | N/A | N/A | 442692 | 442711 | TTGGAGGATATTAAGTGGAT | 14 | 2543 |
| 1041671 | N/A | N/A | 443043 | 443062 | TTCTAGACTTTCATCAGCTG | 102 | 2544 |
| 1041703 | N/A | N/A | 443494 | 443513 | CTTTACCAATACATTTTACA | 61 | 2545 |
| 1041735 | N/A | N/A | 443936 | 443955 | ATTCATCGCCACCAAGCTCG | 48 | 2546 |
| 1041767 | N/A | N/A | 444343 | 444362 | ATCTATCACACCAATGCAAG | 29 | 2547 |
| 1041799 | N/A | N/A | 445241 | 445260 | GCTGGGTTTTCTTACACAT | 25 | 2548 |
| 1041831 | N/A | N/A | 445587 | 445606 | AGTGAAATTCTCAGTCTTGT | 37 | 2549 |
| 1041863 | N/A | N/A | 445806 | 445825 | GTTGTTTAAATATGTCTCCC | 8 | 2550 |
| 1041895 | N/A | N/A | 446045 | 446064 | TGTCACCTTCCTAATCTGAC | 51 | 2551 |
| 1041927 | N/A | N/A | 446680 | 446699 | GCCTTTATAACTTTTCTTTC | 11 | 2552 |
| 1041959 | N/A | N/A | 446892 | 446911 | TGTTAGTAATCATTAAGTCA | 12 | 2553 |

TABLE 34-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041991 | N/A | N/A | 447705 | 447724 | CCAAAAAATCTTCTTCCATG | 45 | 2554 |
| 1042023 | N/A | N/A | 448476 | 448495 | TTCTTTAACCCCTCTTGCGC | 94 | 2555 |
| 1042055 | N/A | N/A | 448712 | 448731 | CTTGGAATCATACTTTCTTC | 55 | 2556 |
| 1042087 | N/A | N/A | 449061 | 449080 | ATTGAGGGTTCCTAATGATA | 46 | 2557 |
| 1042119 | N/A | N/A | 449602 | 449621 | TCAGTGAGAATATATATCAT | 98 | 2558 |
| 1042151 | N/A | N/A | 449921 | 449940 | CAGATAATCTGATCATTGTA | 45 | 2559 |
| 1042183 | N/A | N/A | 450531 | 450550 | GTGGTGTGAACCATAGCTAG | 97 | 2560 |
| 1042215 | N/A | N/A | 451169 | 451188 | CCCCCCATACCCCCCTCCCA | 92 | 2561 |
| 1042247 | N/A | N/A | 451567 | 451586 | GGGTTTTACCCTTTCCTGCA | 99 | 2562 |
| 1042279 | N/A | N/A | 451933 | 451952 | GCCACATTATACACACTTCA | 13 | 2563 |
| 1042311 | N/A | N/A | 452245 | 452264 | GTCATTAACAACATAAACTG | 21 | 2564 |
| 1042343 | N/A | N/A | 452496 | 452515 | CCATGGTACAGATAATTGTG | 105 | 2565 |
| 1042375 | N/A | N/A | 453045 | 453064 | CTGATACATTTCTAGAATGA | 28 | 2566 |
| 1042407 | N/A | N/A | 453852 | 453871 | TCACAGTTTACATCTCAACA | 28 | 2567 |
| 1042439 | N/A | N/A | 454686 | 454705 | TAGAATTAAAATATACACCA | 69 | 2568 |
| 1042471 | N/A | N/A | 455291 | 455310 | GTCTTGAATTACTTTCACAA | 9 | 2569 |
| 1042503 | N/A | N/A | 456245 | 456264 | TGGACCAACCCTCCTTCTGA | 81 | 2570 |
| 1042535 | N/A | N/A | 456967 | 456986 | TCCCCCAGCCACACACTATA | 102 | 2571 |

TABLE 35

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 1 | 138 |
| 1040104 | 2348 | 2367 | 437067 | 437086 | TCAGGTAGCCGATGACAGGG | 44 | 2572 |
| 1040136 | 3181 | 3200 | 457434 | 457453 | TTCGCCATTCTCAGAGAGCA | 57 | 2573 |
| 1040168 | 3937 | 3956 | 458190 | 458209 | GCTGGGTTCCTGATGTTGAT | 31 | 2574 |
| 1040200 | 4485 | 4504 | 458738 | 458757 | AATCTAATTCCTCATGTCAC | 21 | 2575 |
| 1040232 | 4741 | 4760 | 458994 | 459013 | AGTTCATAATTCACATTCAT | 13 | 2576 |
| 1040264 | 5162 | 5181 | 459415 | 459434 | TCAGAGTTTCTAAGAGCCCG | 17 | 2577 |
| 1040296 | 5477 | 5496 | 459730 | 459749 | GCAGCCATCCAAGTAAGAAT | 16 | 2578 |
| 1040328 | 5913 | 5932 | 460166 | 460185 | GCCCGTATTCCTCTTACCAT | 12 | 2579 |
| 1040360 | 6268 | 6287 | 460521 | 460540 | GGAAGATCAACCAAACAAGG | 46 | 2580 |
| 1040392 | 7061 | 7080 | 461314 | 461333 | GTATTATTTTTTTCTTTTCG | 11 | 2581 |

TABLE 35-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040424 | 7563 | 7582 | 461816 | 461835 | CAGAGCAGTCAAAGTGCTGC | 118 | 2582 |
| 1040456 | 7970 | 7989 | 462223 | 462242 | AGCCATGACAACCAACACAG | 63 | 2583 |
| 1040488 | 8289 | 8308 | 462542 | 462561 | AAGAGAGGAAACCAACCCAA | 50 | 2584 |
| 1040520 | 8663 | 8682 | 462916 | 462935 | AACTTTCAACCCTTCTCTGC | 37 | 2585 |
| 1040552 | 9040 | 9059 | 463293 | 463312 | ATAATGAGTCCTGTTTGATT | 20 | 2586 |
| 1040584 | 9377 | 9396 | 463630 | 463649 | CCGGTGTTCCCTCCCGCCAT | 85 | 2587 |
| 1040616 | 9772 | 9791 | 464025 | 464044 | CAGAGAAACCTGTGCACCG | 71 | 2588 |
| 1040648 | 10214 | 10233 | 464467 | 464486 | AAGGTGCAAAACATCATTCC | 35 | 2589 |
| 1040680 | 10463 | 10482 | 464716 | 464735 | AAGCACCATCAAAGAAAGGG | 24 | 2590 |
| 1040712 | N/A | N/A | 14174 | 14193 | ACCCAATTTCAAAGATCACT | 29 | 2591 |
| 1040744 | N/A | N/A | 28305 | 28324 | GTTCACAAAATACATTAAGT | 6 | 2592 |
| 1040776 | N/A | N/A | 43918 | 43937 | AGATCAATTCAAAGGCTCCT | 62 | 2593 |
| 1040808 | N/A | N/A | 74369 | 74388 | GATTTGTATTTTTAATTGAC | 58 | 2594 |
| 1040840 | N/A | N/A | 89862 | 89881 | TTGACATTTTAAAACAGCTC | 40 | 2595 |
| 1040872 | N/A | N/A | 114285 | 114304 | AAGCTTATCCAAAAACATTT | 70 | 2596 |
| 1040904 | N/A | N/A | 143859 | 143878 | CCCCTCAACCAAACTTTTAC | 116 | 2597 |
| 1040936 | N/A | N/A | 172540 | 172559 | TATTAATTTCATTACCATGA | 92 | 2598 |
| 1040968 | N/A | N/A | 190768 | 190787 | CCTAGAATACATTATTCCTC | 56 | 2599 |
| 1041000 | N/A | N/A | 209947 | 209966 | AGCATATTTTAAAGAAGAAG | 76 | 2600 |
| 1041032 | N/A | N/A | 233011 | 233030 | GTCCATACACCTTAATAAGT | 29 | 2601 |
| 1041064 | N/A | N/A | 256096 | 256115 | GATTACTTTTAAAAGCAACA | 54 | 2602 |
| 1041096 | N/A | N/A | 273624 | 273643 | CCTAAAAGAATTTATCCATA | 96 | 2603 |
| 1041128 | N/A | N/A | 290841 | 290860 | CTTGGCAAATTATTATCTGC | 12 | 2604 |
| 1041160 | N/A | N/A | 322672 | 322691 | GCTAAGAAAATATAGGCCTT | 73 | 2605 |
| 1041192 | N/A | N/A | 343258 | 343277 | GGCTTTATAGTCTAAGTTGC | 7 | 2606 |
| 1041224 | N/A | N/A | 369453 | 369472 | ACTTCAAACCTTTATCAGTT | 3 | 2607 |
| 1041256 | N/A | N/A | 388260 | 388279 | CAAACCCAAATTTAGCTCTG | 41 | 2608 |
| 1041288 | N/A | N/A | 420471 | 420490 | CCTTTAAGCCCTTAAAGCTG | 110 | 2609 |
| 1041320 | N/A | N/A | 437794 | 437813 | GAGGTTAATTCATTACACAC | 5 | 2610 |
| 1041352 | N/A | N/A | 438248 | 438267 | GGCCTTATCATACCTAAATA | 61 | 2611 |
| 1041384 | N/A | N/A | 438538 | 438557 | ACCAGCAGCCAGACAACTAA | 66 | 2612 |
| 1041416 | N/A | N/A | 439148 | 439167 | TACCCCAAGCCCAGCAGGTC | 108 | 2613 |
| 1041448 | N/A | N/A | 439513 | 439532 | CCAAAACAATTCAAACCATT | 40 | 2614 |
| 1041480 | N/A | N/A | 440152 | 440171 | TTTCTCCTAGTACCCACCCC | 78 | 2615 |
| 1041512 | N/A | N/A | 440369 | 440388 | AAGTGGCTGCCTTCATTCTC | 44 | 2616 |
| 1041544 | N/A | N/A | 441287 | 441306 | GGAACCTCAATTAAGTCCAG | 38 | 2617 |

TABLE 35-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041576 | N/A | N/A | 441615 | 441634 | CACCATACTATATCACACTG | 29 | 2618 |
| 1041608 | N/A | N/A | 442256 | 442275 | CCTCAGTTTTATATGCCATG | 6 | 2619 |
| 1041640 | N/A | N/A | 442706 | 442725 | TTATGGCCTCAAACTTGGAG | 53 | 2620 |
| 1041672 | N/A | N/A | 443046 | 443065 | TCTTTCTAGACTTTCATCAG | 33 | 2621 |
| 1041704 | N/A | N/A | 443496 | 443515 | CACTTTACCAATACATTTTA | 80 | 2622 |
| 1041736 | N/A | N/A | 443941 | 443960 | TTAGGATTCATCGCCACCAA | 19 | 2623 |
| 1041768 | N/A | N/A | 444346 | 444365 | CCAATCTATCACACCAATGC | 24 | 2624 |
| 1041800 | N/A | N/A | 445254 | 445273 | TCCCACATTAAAAGCTGGGT | 109 | 2625 |
| 1041832 | N/A | N/A | 445593 | 445612 | TCTGCAAGTGAAATTCTCAG | 66 | 2626 |
| 1041864 | N/A | N/A | 445849 | 445868 | GTACATATCACCAAAAACAA | 57 | 2627 |
| 1041896 | N/A | N/A | 446046 | 446065 | ATGTCACCTTCCTAATCTGA | 26 | 2628 |
| 1041928 | N/A | N/A | 446684 | 446703 | AATAGCCTTTATAACTTTTC | 18 | 2629 |
| 1041960 | N/A | N/A | 446894 | 446913 | TGTGTTAGTAATCATTAAGT | 19 | 2630 |
| 1041992 | N/A | N/A | 447708 | 447727 | CTGCCAAAAAATCTTCTTCC | 50 | 2631 |
| 1042024 | N/A | N/A | 448482 | 448501 | TGCTGGTTCTTTAACCCCTC | 40 | 2632 |
| 1042056 | N/A | N/A | 448729 | 448748 | GCTGTTCAATCAAGCACCTT | 76 | 2633 |
| 1042088 | N/A | N/A | 449072 | 449091 | CTCAAAATATTATTGAGGGT | 35 | 2634 |
| 1042120 | N/A | N/A | 449604 | 449623 | TCTCAGTGAGAATATATATC | 103 | 2635 |
| 1042152 | N/A | N/A | 449922 | 449941 | TCAGATAATCTGATCATTGT | 54 | 2636 |
| 1042184 | N/A | N/A | 450547 | 450566 | CTTAGAATTAAATGCTGTGG | 63 | 2637 |
| 1042216 | N/A | N/A | 451173 | 451192 | GTCTCCCCCATACCCCCCT | 81 | 2638 |
| 1042248 | N/A | N/A | 451670 | 451689 | AACTCCAAAGACACCACTCT | 86 | 2639 |
| 1042280 | N/A | N/A | 451934 | 451953 | AGCCACATTATACACACTTC | 16 | 2640 |
| 1042312 | N/A | N/A | 452252 | 452271 | TCTTAGAGTCATTAACAACA | 15 | 2641 |
| 1042344 | N/A | N/A | 452506 | 452525 | TGGGCTTGTTCCATGGTACA | 42 | 2642 |
| 1042376 | N/A | N/A | 453046 | 453065 | TCTGATACATTTCTAGAATG | 36 | 2643 |
| 1042408 | N/A | N/A | 453854 | 453873 | ACTCACAGTTTACATCTCAA | 16 | 2644 |
| 1042440 | N/A | N/A | 454687 | 454706 | GTAGAATTAAAATATACACC | 17 | 2645 |
| 1042472 | N/A | N/A | 455293 | 455312 | AGGTCTTGAATTACTTTCAC | 7 | 2646 |
| 1042504 | N/A | N/A | 456246 | 456265 | TTGGACCAACCCTCCTTCTG | 114 | 2647 |
| 1042536 | N/A | N/A | 456983 | 457002 | TTTGCAAACCTCCCTCTCCC | 106 | 2648 |

TABLE 36

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 2 | 138 |
| 1040105 | 2350 | 2369 | 437069 | 437088 | GCTCAGGTAGCCGATGACAG | 84 | 2649 |
| 1040137 | 3185 | 3204 | 457438 | 457457 | TCAGTTCGCCATTCTCAGAG | 68 | 2650 |
| 1040169 | 3938 | 3957 | 458191 | 458210 | AGCTGGGTTCCTGATGTTGA | 45 | 2651 |
| 1040201 | 4488 | 4507 | 458741 | 458760 | CAAAATCTAATTCCTCATGT | 61 | 2652 |
| 1040233 | 4742 | 4761 | 458995 | 459014 | TAGTTCATAATTCACATTCA | 19 | 2653 |
| 1040265 | 5163 | 5182 | 459416 | 459435 | CTCAGAGTTTCTAAGAGCCC | 27 | 2654 |
| 1040297 | 5481 | 5500 | 459734 | 459753 | AGTTGCAGCCATCCAAGTAA | 26 | 2655 |
| 1040329 | 5914 | 5933 | 460167 | 460186 | AGCCCGTATTCCTCTTACCA | 22 | 2656 |
| 1040361 | 6269 | 6288 | 460522 | 460541 | GGGAAGATCAACCAAACAAG | 37 | 2657 |
| 1040393 | 7076 | 7095 | 461329 | 461348 | GGTTTCTTATTAATAGTATT | 23 | 2658 |
| 1040425 | 7575 | 7594 | 461828 | 461847 | ACAACCCTACTCCAGAGCAG | 59 | 2659 |
| 1040457 | 7976 | 7995 | 462229 | 462248 | AACAGTAGCCATGACAACCA | 80 | 2660 |
| 1040489 | 8317 | 8336 | 462570 | 462589 | TGCCAGAAACACAACACTGT | 88 | 2661 |
| 1040521 | 8668 | 8687 | 462921 | 462940 | CATGTAACTTTCAACCCTTC | 28 | 2662 |
| 1040553 | 9050 | 9069 | 463303 | 463322 | TTTTGTCCCCATAATGAGTC | 47 | 2663 |
| 1040585 | 9393 | 9412 | 463646 | 463665 | ACATGAAAAACTGAAGCCGG | 67 | 2664 |
| 1040617 | 9815 | 9834 | 464068 | 464087 | CCTGGGCCAGAAAACTGAAA | 131 | 2665 |
| 1040649 | 10226 | 10245 | 464479 | 464498 | TTTCTTTTCAATAAGGTGCA | 14 | 2666 |
| 1040681 | 10476 | 10495 | 464729 | 464748 | CTAGAAAACCTGCAAGCACC | 32 | 2667 |
| 1040713 | N/A | N/A | 14562 | 14581 | GCTGAATTTCAAACGCAGCA | 96 | 2668 |
| 1040745 | N/A | N/A | 28358 | 28377 | GCAGTAATTTAAAGTATGAA | 35 | 2669 |
| 1040777 | N/A | N/A | 44806 | 44825 | AACAAATTTTAAAGCTCTTT | 36 | 2670 |
| 1040809 | N/A | N/A | 75467 | 75486 | AGCATCAACCAAATTCAGTA | 20 | 2671 |
| 1040841 | N/A | N/A | 91912 | 91931 | CCCTGACCTATTTAACATAC | 135 | 2672 |
| 1040873 | N/A | N/A | 114340 | 114359 | CTGTTTAACCAAAAACATCT | 85 | 2673 |
| 1040905 | N/A | N/A | 144629 | 144648 | ATCACTAAACGATAGCACAA | 102 | 2674 |
| 1040937 | N/A | N/A | 172695 | 172714 | AACTCCTTTTAAATTGAATT | 111 | 2675 |
| 1040969 | N/A | N/A | 193065 | 193084 | GGGATTAAATAATTATGTGC | 13 | 2676 |
| 1041001 | N/A | N/A | 209950 | 209969 | GCTAGCATATTTAAAGAAG | 138 | 2677 |
| 1041033 | N/A | N/A | 233976 | 233995 | CCAGCATTTCAAAGAGCAAC | 69 | 2678 |
| 1041065 | N/A | N/A | 256246 | 256265 | GGCATGTTTATATAACAGCC | 124 | 2679 |
| 1041097 | N/A | N/A | 273626 | 273645 | TTCCTAAAAGAATTTATCCA | 108 | 2680 |
| 1041129 | N/A | N/A | 291710 | 291729 | GTTTCAATATTTTATGCAAA | 3 | 2681 |
| 1041161 | N/A | N/A | 322739 | 322758 | GCAGTAATAATTTAGCCAAA | 5 | 2682 |
| 1041193 | N/A | N/A | 343540 | 343559 | GCTATTAGACAATATAGAGT | 2 | 2683 |

TABLE 36-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041225 | N/A | N/A | 369454 | 369473 | CACTTCAAACCTTTATCAGT | 30 | 2684 |
| 1041257 | N/A | N/A | 389567 | 389586 | AATCCTTTAATTTAACAACC | 111 | 2685 |
| 1041289 | N/A | N/A | 423903 | 423922 | CCATGAAGAATTTAACCTCA | 90 | 2686 |
| 1041321 | N/A | N/A | 437795 | 437814 | GGAGGTTAATTCATTACACA | 6 | 2687 |
| 1041353 | N/A | N/A | 438249 | 438268 | TGGCCTTATCATACCTAAAT | 80 | 2688 |
| 1041385 | N/A | N/A | 438553 | 438572 | ATTGATCACCCCAGCACCAG | 88 | 2689 |
| 1041417 | N/A | N/A | 439149 | 439168 | TTACCCCAAGCCCAGCAGGT | 95 | 2690 |
| 1041449 | N/A | N/A | 439514 | 439533 | CCCAAAACAATTCAAACCAT | 69 | 2691 |
| 1041481 | N/A | N/A | 440158 | 440177 | ATTTTCTTTCTCCTAGTACC | 69 | 2692 |
| 1041513 | N/A | N/A | 440406 | 440425 | AGAGGCTGCCAGGCCTGGGA | 106 | 2693 |
| 1041545 | N/A | N/A | 441288 | 441307 | TGGAACCTCAATTAAGTCCA | 75 | 2694 |
| 1041577 | N/A | N/A | 441617 | 441636 | ACCACCATACTATATCACAC | 37 | 2695 |
| 1041609 | N/A | N/A | 442257 | 442276 | CCCTCAGTTTTATATGCCAT | 17 | 2696 |
| 1041641 | N/A | N/A | 442708 | 442727 | ACTTATGGCCTCAAACTTGG | 63 | 2697 |
| 1041673 | N/A | N/A | 443057 | 443076 | AAGTTCAGCCTTCTTTCTAG | 28 | 2698 |
| 1041705 | N/A | N/A | 443498 | 443517 | AGCACTTTACCAATACATTT | 46 | 2699 |
| 1041737 | N/A | N/A | 443961 | 443980 | ACTATCTATTTTTGATACA | 63 | 2700 |
| 1041769 | N/A | N/A | 444350 | 444369 | GTAACCAATCTATCACACCA | 20 | 2701 |
| 1041801 | N/A | N/A | 445255 | 445274 | ATCCCACATTAAAAGCTGGG | 121 | 2702 |
| 1041833 | N/A | N/A | 445608 | 445627 | GCATTCTTAACTTTGTCTGC | 47 | 2703 |
| 1041865 | N/A | N/A | 445874 | 445893 | GTGCTATGTCTATATACACA | 71 | 2704 |
| 1041897 | N/A | N/A | 446067 | 446086 | GGGCTCATAATTATTTTTA | 103 | 2705 |
| 1041929 | N/A | N/A | 446685 | 446704 | GAATAGCCTTTATAACTTTT | 12 | 2706 |
| 1041961 | N/A | N/A | 446928 | 446947 | TCAGTTATTTTCTCTCCACT | 9 | 2707 |
| 1041993 | N/A | N/A | 447709 | 447728 | CCTGCCAAAAAATCTTCTTC | 127 | 2708 |
| 1042025 | N/A | N/A | 448483 | 448502 | TTGCTGGTTCTTTAACCCCT | 31 | 2709 |
| 1042057 | N/A | N/A | 448731 | 448750 | CGGCTGTTCAATCAAGCACC | 85 | 2710 |
| 1042089 | N/A | N/A | 449073 | 449092 | CCTCAAAATATTATTGAGGG | 153 | 2711 |
| 1042121 | N/A | N/A | 449627 | 449646 | TGAAGAAATCTCACTGAGGG | 149 | 2712 |
| 1042153 | N/A | N/A | 449929 | 449948 | AGATTATTCAGATAATCTGA | 125 | 2713 |
| 1042185 | N/A | N/A | 450548 | 450567 | CCTTAGAATTAAATGCTGTG | 84 | 2714 |
| 1042217 | N/A | N/A | 451193 | 451212 | TCCTCGATACTAACCCCTTC | 93 | 2715 |
| 1042249 | N/A | N/A | 451674 | 451693 | TCAAAACTCCAAAGACACCA | 67 | 2716 |
| 1042281 | N/A | N/A | 451935 | 451954 | GAGCCACATTATACACACTT | 30 | 2717 |
| 1042313 | N/A | N/A | 452254 | 452273 | CCTCTTAGAGTCATTAACAA | 62 | 2718 |
| 1042345 | N/A | N/A | 452531 | 452550 | AGTAGGATCCAAAGGCATGA | 29 | 2719 |

TABLE 36-continued

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1042377 | N/A | N/A | 453048 | 453067 | GTTCTGATACATTTCTAGAA | 37 | 2720 |
| 1042409 | N/A | N/A | 453856 | 453875 | GAACTCACAGTTTACATCTC | 53 | 2721 |
| 1042441 | N/A | N/A | 454688 | 454707 | TGTAGAATTAAAATATACAC | 95 | 2722 |
| 1042473 | N/A | N/A | 455314 | 455333 | TGAGTCCCTAAAACTGGATT | 112 | 2723 |
| 1042505 | N/A | N/A | 456275 | 456294 | TCCTTTCTAGATGTAGTAGA | 25 | 2724 |
| 1042537 | N/A | N/A | 456984 | 457003 | GTTTGCAAACCTCCCTCTCC | 101 | 2725 |

TABLE 37

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 3 | 138 |
| 1040106 | 2686 | 2705 | 437405 | 437424 | GGAGCCTTTCATGAAGTAGG | 28 | 2726 |
| 1040138 | 3195 | 3214 | 457448 | 457467 | TCTGGAAACTTCAGTTCGCC | 91 | 2727 |
| 1040170 | 3984 | 4003 | 458237 | 458256 | TTAACTTTCCAAATCTGCCA | 21 | 2728 |
| 1040202 | 4491 | 4510 | 458744 | 458763 | CTTCAAAATCTAATTCCTCA | 43 | 2729 |
| 1040234 | 4745 | 4764 | 458998 | 459017 | TACTAGTTCATAATTCACAT | 29 | 2730 |
| 1040266 | 5164 | 5183 | 459417 | 459436 | TCTCAGAGTTTCTAAGAGCC | 28 | 2731 |
| 1040298 | 5494 | 5513 | 459747 | 459766 | ATTTGTTCAGTTTAGTTGCA | 10 | 2732 |
| 1040330 | 5934 | 5953 | 460187 | 460206 | GAGAACAAAGTCTATGTGGC | 19 | 2733 |
| 1040362 | 6304 | 6323 | 460557 | 460576 | GGCTCCTTCCCTCCAGCCCT | 115 | 2734 |
| 1040394 | 7078 | 7097 | 461331 | 461350 | TTGGTTTCTTATTAATAGTA | 11 | 2735 |
| 1040426 | 7579 | 7598 | 461832 | 461851 | TTGTACAACCCTACTCCAGA | 78 | 2736 |
| 1040458 | 7985 | 8004 | 462238 | 462257 | GGTTCATGAAACAGTAGCCA | 93 | 2737 |
| 1040490 | 8319 | 8338 | 462572 | 462591 | TATGCCAGAAACACAACACT | 86 | 2738 |
| 1040522 | 8669 | 8688 | 462922 | 462941 | ACATGTAACTTTCAACCCTT | 29 | 2739 |
| 1040554 | 9051 | 9070 | 463304 | 463323 | TTTTTGTCCCCATAATGAGT | 34 | 2740 |
| 1040586 | 9396 | 9415 | 463649 | 463668 | GGGACATGAAAAACTGAAGC | 22 | 2741 |
| 1040618 | 9830 | 9849 | 464083 | 464102 | AGGATTTACCCCACTCCTGG | 82 | 2742 |
| 1040650 | 10228 | 10247 | 464481 | 464500 | ATTTTCTTTTCAATAAGGTG | 17 | 2743 |
| 1040682 | 10481 | 10500 | 464734 | 464753 | TCTACCTAGAAACCTGCAA | 44 | 2744 |
| 1040714 | N/A | N/A | 14865 | 14884 | CTCACATTTTAAAGAGTCTG | 41 | 2745 |
| 1040746 | N/A | N/A | 29049 | 29068 | TCACTGAACCCTTATTTTTT | 30 | 2746 |
| 1040778 | N/A | N/A | 46649 | 46668 | ACTAGAAAAGCCACCCTTCT | 129 | 2747 |
| 1040810 | N/A | N/A | 76238 | 76257 | AGTCTGTATATTTATATTTA | 47 | 2748 |

TABLE 37-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040842 | N/A | N/A | 92036 | 92055 | CCTTTGTTTTAAAATAGGTA | 122 | 2749 |
| 1040874 | N/A | N/A | 114410 | 114429 | AATGCCAAAGATATACGCCA | 6 | 2750 |
| 1040906 | N/A | N/A | 145082 | 145101 | AGTTAATATCCTTAATACAA | 44 | 2751 |
| 1040938 | N/A | N/A | 173470 | 173489 | AAGTACTATCATTATTGCAT | 113 | 2752 |
| 1040970 | N/A | N/A | 193239 | 193258 | TTCCCCTTATTTTATTCATA | 63 | 2753 |
| 1041002 | N/A | N/A | 210713 | 210732 | TTCCTTCTAGATTAAAGACT | 62 | 2754 |
| 1041034 | N/A | N/A | 234265 | 234284 | AACACAATTTAAATTGAGTT | 127 | 2755 |
| 1041066 | N/A | N/A | 256364 | 256383 | CCTAAGTACCCTTAATTTTT | 65 | 2756 |
| 1041098 | N/A | N/A | 273876 | 273895 | TGTCTATTTCAAAGAAGCGA | 80 | 2757 |
| 1041130 | N/A | N/A | 292765 | 292784 | CACACAATTCAAAACTTGAA | 93 | 2758 |
| 1041162 | N/A | N/A | 322761 | 322780 | AGCAGAATCTAAATCGAACA | 22 | 2759 |
| 1041194 | N/A | N/A | 343565 | 343584 | CGTGTTTTTATTTAACAATA | 2 | 2760 |
| 1041226 | N/A | N/A | 369541 | 369560 | ATTTCTTATATTTATGGGCT | 3 | 2761 |
| 1041258 | N/A | N/A | 391393 | 391412 | TATAGTAGTATTTATAGCTC | 28 | 2762 |
| 1041290 | N/A | N/A | 424357 | 424376 | ACCCCATTTCAAAGACAAGG | 59 | 2763 |
| 1041322 | N/A | N/A | 437796 | 437815 | TGGAGGTTAATTCATTACAC | 12 | 2764 |
| 1041354 | N/A | N/A | 438250 | 438269 | TTGGCCTTATCATACCTAAA | 34 | 2765 |
| 1041386 | N/A | N/A | 438574 | 438593 | GTGCCCAGCCCTTCCACCTG | 55 | 2766 |
| 1041418 | N/A | N/A | 439153 | 439172 | GACTTTACCCCAAGCCCAGC | 98 | 2767 |
| 1041450 | N/A | N/A | 439516 | 439535 | TGCCCAAAACAATTCAAACC | 94 | 2768 |
| 1041482 | N/A | N/A | 440163 | 440182 | AGTTCATTTCTTTCTCCTA | 5 | 2769 |
| 1041514 | N/A | N/A | 440419 | 440438 | GTCTGGTTTCTGCAGAGGCT | 42 | 2770 |
| 1041546 | N/A | N/A | 441292 | 441311 | CCTTTGGAACCTCAATTAAG | 89 | 2771 |
| 1041578 | N/A | N/A | 441621 | 441640 | TGTCACCACCATACTATATC | 26 | 2772 |
| 1041610 | N/A | N/A | 442258 | 442277 | CCCCTCAGTTTTATATGCCA | 45 | 2773 |
| 1041642 | N/A | N/A | 442717 | 442736 | GCGCCACAGACTTATGGCCT | 142 | 2774 |
| 1041674 | N/A | N/A | 443092 | 443111 | GGCAGGGTAAAAATGGCTTA | 52 | 2775 |
| 1041706 | N/A | N/A | 443499 | 443518 | GAGCACTTTACCAATACATT | 23 | 2776 |
| 1041738 | N/A | N/A | 443965 | 443984 | ACCAACTATCTATTTTTGA | 51 | 2777 |
| 1041770 | N/A | N/A | 444351 | 444370 | TGTAACCAATCTATCACACC | 30 | 2778 |
| 1041802 | N/A | N/A | 445261 | 445280 | ACACAAATCCCACATTAAAA | 92 | 2779 |
| 1041834 | N/A | N/A | 445611 | 445630 | TGGGCATTCTTAACTTTGTC | 28 | 2780 |
| 1041866 | N/A | N/A | 445897 | 445916 | TTGTATATTTCAATCTTAGA | 26 | 2781 |
| 1041898 | N/A | N/A | 446071 | 446090 | TTCTGGGCTCATAATTATTT | 52 | 2782 |
| 1041930 | N/A | N/A | 446687 | 446706 | TAGAATAGCCTTTATAACTT | 33 | 2783 |
| 1041962 | N/A | N/A | 446929 | 446948 | TTCAGTTATTTTCTCTCCAC | 16 | 2784 |

TABLE 37-continued

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041994 | N/A | N/A | 447710 | 447729 | TCCTGCCAAAAAATCTTCTT | 118 | 2785 |
| 1042026 | N/A | N/A | 448513 | 448532 | ACTCCCTACACTGTAGCAAC | 97 | 2786 |
| 1042058 | N/A | N/A | 448749 | 448768 | AATGGTATCCCATTCTTCCG | 63 | 2787 |
| 1042090 | N/A | N/A | 449075 | 449094 | GGCCTCAAAATATTATTGAG | 107 | 2788 |
| 1042122 | N/A | N/A | 449649 | 449668 | TTAACTGATCATTAACCGTT | 49 | 2789 |
| 1042154 | N/A | N/A | 449930 | 449949 | AAGATTATTCAGATAATCTG | 178 | 2790 |
| 1042186 | N/A | N/A | 450550 | 450569 | GGCCTTAGAATTAAATGCTG | 145 | 2791 |
| 1042218 | N/A | N/A | 451194 | 451213 | CTCCTCGATACTAACCCCTT | 118 | 2792 |
| 1042250 | N/A | N/A | 451676 | 451695 | TCTCAAAACTCCAAAGACAC | 80 | 2793 |
| 1042282 | N/A | N/A | 451937 | 451956 | GTGAGCCACATTATACACAC | 69 | 2794 |
| 1042314 | N/A | N/A | 452263 | 452282 | TCTTGCAAACCTCTTAGAGT | 74 | 2795 |
| 1042346 | N/A | N/A | 452544 | 452563 | ATTGACTGAAATAAGTAGGA | 16 | 2796 |
| 1042378 | N/A | N/A | 453050 | 453069 | TAGTTCTGATACATTTCTAG | 47 | 2797 |
| 1042410 | N/A | N/A | 453883 | 453902 | CATATTATCTCCAAATAAGC | 124 | 2798 |
| 1042442 | N/A | N/A | 454701 | 454720 | GGTCTATGAGAATTGTAGAA | 32 | 2799 |
| 1042474 | N/A | N/A | 455315 | 455334 | CTGAGTCCCTAAAACTGGAT | 78 | 2800 |
| 1042506 | N/A | N/A | 456290 | 456309 | AGTCAATTTCCAATGTCCTT | 21 | 2801 |
| 1042538 | N/A | N/A | 456985 | 457004 | AGTTTGCAAACCTCCCTCTC | 117 | 2802 |

TABLE 38

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 2 | 138 |
| 1040107 | 2687 | 2706 | 437406 | 437425 | TGGAGCCTTTCATGAAGTAG | 23 | 2803 |
| 1040139 | 3196 | 3215 | 457449 | 457468 | CTCTGGAAACTTCAGTTCGC | 87 | 2804 |
| 1040171 | 3985 | 4004 | 458238 | 458257 | GTTAACTTTCCAAATCTGCC | 23 | 2805 |
| 1040203 | 4493 | 4512 | 458746 | 458765 | ATCTTCAAAATCTAATTCCT | 45 | 2806 |
| 1040235 | 4746 | 4765 | 458999 | 459018 | ATACTAGTTCATAATTCACA | 35 | 2807 |
| 1040267 | 5172 | 5191 | 459425 | 459444 | AAGAAAATTCTCAGAGTTTC | 56 | 2808 |
| 1040299 | 5502 | 5521 | 459755 | 459774 | AGTCAGGTATTTGTTCAGTT | 5 | 2809 |
| 1040331 | 5952 | 5971 | 460205 | 460224 | GTAAATAGTGATATTAATGA | 53 | 2810 |
| 1040363 | 6365 | 6384 | 460618 | 460637 | GCTCCCCGCCCCAGCACTCA | 102 | 2811 |
| 1040395 | 7081 | 7100 | 461334 | 461353 | TTGTTGGTTTCTTATTAATA | 16 | 2812 |

TABLE 38-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040427 | 7580 | 7599 | 461833 | 461852 | ATTGTACAACCCTACTCCAG | 70 | 2813 |
| 1040459 | 7987 | 8006 | 462240 | 462259 | GTGGTTCATGAAACAGTAGC | 88 | 2814 |
| 1040491 | 8321 | 8340 | 462574 | 462593 | CCTATGCCAGAAACACAACA | 72 | 2815 |
| 1040523 | 8683 | 8702 | 462936 | 462955 | CTATATACAAAAAAACATGT | 121 | 2816 |
| 1040555 | 9099 | 9118 | 463352 | 463371 | CCCCCATTTAAATGAGGTGT | 141 | 2817 |
| 1040587 | 9424 | 9443 | 463677 | 463696 | CAGTTGAACCATTTGTATGC | 22 | 2818 |
| 1040619 | 9842 | 9861 | 464095 | 464114 | TGCACTAACTAAAGGATTTA | 46 | 2819 |
| 1040651 | 10229 | 10248 | 464482 | 464501 | AATTTTCTTTTCAATAAGGT | 93 | 2820 |
| 1040683 | 10482 | 10501 | 464735 | 464754 | TTCTACCTAGAAAACCTGCA | 41 | 2821 |
| 1040715 | N/A | N/A | 16686 | 16705 | CTCGAAAAACATATCCCCCA | 52 | 2822 |
| 1040747 | N/A | N/A | 29088 | 29107 | TGGTAATTTTAAAATATGGG | 15 | 2823 |
| 1040779 | N/A | N/A | 48578 | 48597 | GTGTTAATTCAAAAAATTTC | 119 | 2824 |
| 1040811 | N/A | N/A | 76251 | 76270 | TGCATACAAATTTAGTCTGT | 21 | 2825 |
| 1040843 | N/A | N/A | 93032 | 93051 | TCTAGATTACAAACCATCCT | 110 | 2826 |
| 1040875 | N/A | N/A | 114768 | 114787 | TTTCATTTTATTTAAGCCAA | 20 | 2827 |
| 1040907 | N/A | N/A | 146636 | 146655 | AAGATGTTTTAAAATCTGAC | 107 | 2828 |
| 1040939 | N/A | N/A | 174742 | 174761 | GTACTTGTTCCTTAACCAAG | 149 | 2829 |
| 1040971 | N/A | N/A | 193345 | 193364 | TCAGTTTACCTTTAATGGAA | 30 | 2830 |
| 1041003 | N/A | N/A | 211774 | 211793 | TGCTCAATATTTTAAACATT | 44 | 2831 |
| 1041035 | N/A | N/A | 234289 | 234308 | GTCGGATAAATTTATCCACA | 131 | 2832 |
| 1041067 | N/A | N/A | 256544 | 256563 | TTAGCAAACATTTATGAGCA | 45 | 2833 |
| 1041099 | N/A | N/A | 274538 | 274557 | CTTCCAATCCATTACATCTT | 81 | 2834 |
| 1041131 | N/A | N/A | 293124 | 293143 | CCTTCCAACCCTTAGCCTTT | 12 | 2835 |
| 1041163 | N/A | N/A | 323168 | 323187 | AGCCAAAAACCCATGGACCA | 120 | 2836 |
| 1041195 | N/A | N/A | 343967 | 343986 | ACAGTAATCTTTTATACAAG | 19 | 2837 |
| 1041227 | N/A | N/A | 369669 | 369688 | TTCCCGAACCCTTAAGGATA | 99 | 2838 |
| 1041259 | N/A | N/A | 391405 | 391424 | AGTTGACACCTTTATAGTAG | 4 | 2839 |
| 1041291 | N/A | N/A | 424646 | 424665 | GTCTTAAAACTATTCACTGT | 81 | 2840 |
| 1041323 | N/A | N/A | 437820 | 437839 | ATAACTAGCCCCACTCTCCA | 98 | 2841 |
| 1041355 | N/A | N/A | 438251 | 438270 | GTTGGCCTTATCATACCTAA | 21 | 2842 |
| 1041387 | N/A | N/A | 438878 | 438897 | GCTGCCTTCCATCTGTTTTT | 90 | 2843 |
| 1041419 | N/A | N/A | 439154 | 439173 | TGACTTTACCCCAAGCCCAG | 109 | 2844 |
| 1041451 | N/A | N/A | 439554 | 439573 | GAGACAAGAAACACTGTCTC | 153 | 2845 |
| 1041483 | N/A | N/A | 440171 | 440190 | CTCAAGGTAGTTCATTTTCT | 10 | 2846 |
| 1041515 | N/A | N/A | 440723 | 440742 | GCCTACAATCCCAGCTTTAG | 88 | 2847 |
| 1041547 | N/A | N/A | 441337 | 441356 | GAGAAACCCCTCAGGAAGG | 115 | 2848 |

TABLE 38-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041579 | N/A | N/A | 441623 | 441642 | TCTGTCACCACCATACTATA | 57 | 2849 |
| 1041611 | N/A | N/A | 442265 | 442284 | CTAAACACCCCTCAGTTTTA | 100 | 2850 |
| 1041643 | N/A | N/A | 442722 | 442741 | TGGATGCGCCACAGACTTAT | 59 | 2851 |
| 1041675 | N/A | N/A | 443093 | 443112 | AGGCAGGGTAAAAATGGCTT | 66 | 2852 |
| 1041707 | N/A | N/A | 443502 | 443521 | CCAGAGCACTTTACCAATAC | 30 | 2853 |
| 1041739 | N/A | N/A | 443966 | 443985 | CACCAACTATCTATTTTTTG | 47 | 2854 |
| 1041771 | N/A | N/A | 444355 | 444374 | CAGTTGTAACCAATCTATCA | 22 | 2855 |
| 1041803 | N/A | N/A | 445267 | 445286 | CTCCTAACACAAATCCCACA | 124 | 2856 |
| 1041835 | N/A | N/A | 445625 | 445644 | CGAAATTATTAAATTGGGCA | 36 | 2857 |
| 1041867 | N/A | N/A | 445899 | 445918 | GATTGTATATTTCAATCTTA | 55 | 2858 |
| 1041899 | N/A | N/A | 446086 | 446105 | ACAACACCGACTCACTTCTG | 41 | 2859 |
| 1041931 | N/A | N/A | 446708 | 446727 | TCAAACACCCTAAGCAGTAA | 74 | 2860 |
| 1041963 | N/A | N/A | 446930 | 446949 | CTTCAGTTATTTTCTCTCCA | 10 | 2861 |
| 1041995 | N/A | N/A | 447711 | 447730 | ATCCTGCCAAAAAATCTTCT | 100 | 2862 |
| 1042027 | N/A | N/A | 448517 | 448536 | CCTTACTCCCTACACTGTAG | 99 | 2863 |
| 1042059 | N/A | N/A | 448770 | 448789 | ATGTTCTTCCCCATCTCCAT | 36 | 2864 |
| 1042091 | N/A | N/A | 449076 | 449095 | CGGCCTCAAAATATTATTGA | 165 | 2865 |
| 1042123 | N/A | N/A | 449669 | 449688 | GATATAAACATTCTTAAAGG | 92 | 2866 |
| 1042155 | N/A | N/A | 449932 | 449951 | GGAAGATTATTCAGATAATC | 24 | 2867 |
| 1042187 | N/A | N/A | 450551 | 450570 | AGGCCTTAGAATTAAATGCT | 137 | 2868 |
| 1042219 | N/A | N/A | 451198 | 451217 | CAGTCTCCTCGATACTAACC | 67 | 2869 |
| 1042251 | N/A | N/A | 451677 | 451696 | ATCTCAAAACTCCAAAGACA | 87 | 2870 |
| 1042283 | N/A | N/A | 451938 | 451957 | TGTGAGCCACATTATACACA | 69 | 2871 |
| 1042315 | N/A | N/A | 452264 | 452283 | CTCTTGCAAACCTCTTAGAG | 99 | 2872 |
| 1042347 | N/A | N/A | 452571 | 452590 | TCCTGCTACCCCCCAACAGT | 124 | 2873 |
| 1042379 | N/A | N/A | 453088 | 453107 | TTCATCTTCTTTGTTTCCTT | 25 | 2874 |
| 1042411 | N/A | N/A | 453892 | 453911 | AACAAAATACATATTATCTC | 99 | 2875 |
| 1042443 | N/A | N/A | 454927 | 454946 | CCGTTTCTACAGAAATTTAA | 78 | 2876 |
| 1042475 | N/A | N/A | 455316 | 455335 | TCTGAGTCCCTAAAACTGGA | 90 | 2877 |
| 1042507 | N/A | N/A | 456620 | 456639 | CCCAGCCCCTAAAAGGATGC | 118 | 2878 |
| 1042539 | N/A | N/A | 457035 | 457054 | AGGTATGAACTCACACAGAC | 63 | 2879 |

TABLE 39

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 2 | 138 |
| 1040108 | 2725 | 2744 | 437444 | 437463 | TTCCACCTTCTTTAGCTCCC | 67 | 2880 |
| 1040140 | 3212 | 3231 | 457465 | 457484 | CAGGCAATCCCATTTTCTCT | 84 | 2881 |
| 1040172 | 4000 | 4019 | 458253 | 458272 | ATGTTCTTTTAAATGGTTAA | 15 | 2882 |
| 1040204 | 4494 | 4513 | 458747 | 458766 | CATCTTCAAAATCTAATTCC | 66 | 2883 |
| 1040236 | 4749 | 4768 | 459002 | 459021 | CACATACTAGTTCATAATTC | 20 | 2884 |
| 1040268 | 5188 | 5207 | 459441 | 459460 | TCTCTCAATGAATCTGAAGA | 26 | 2885 |
| 1040300 | 5514 | 5533 | 459767 | 459786 | GGGTAAAAGAAAAGTCAGGT | 10 | 2886 |
| 1040332 | 5954 | 5973 | 460207 | 460226 | TTGTAAATAGTGATATTAAT | 74 | 2887 |
| 1040364 | 6439 | 6458 | 460692 | 460711 | CTGCGGTTCCTCCCCCGGGT | 124 | 2888 |
| 1040396 | 7117 | 7136 | 461370 | 461389 | ATATATTTAGAAATCCCTAG | 82 | 2889 |
| 1040428 | 7581 | 7600 | 461834 | 461853 | AATTGTACAACCCTACTCCA | 98 | 2890 |
| 1040460 | 8014 | 8033 | 462267 | 462286 | GCAACAGACCAGTCTGTTGA | 113 | 2891 |
| 1040492 | 8323 | 8342 | 462576 | 462595 | TCCCTATGCCAGAAACACAA | 70 | 2892 |
| 1040524 | 8684 | 8703 | 462937 | 462956 | TCTATATACAAAAAACATG | 103 | 2893 |
| 1040556 | 9100 | 9119 | 463353 | 463372 | CCCCCCATTTAAATGAGGTG | 114 | 2894 |
| 1040588 | 9426 | 9445 | 463679 | 463698 | TACAGTTGAACCATTTGTAT | 67 | 2895 |
| 1040620 | 9862 | 9881 | 464115 | 464134 | GCACAGGTATCAAGTTCAAA | 17 | 2896 |
| 1040652 | 10235 | 10254 | 464488 | 464507 | ACTTAAAATTTTCTTTTCAA | 109 | 2897 |
| 1040684 | 10493 | 10512 | 464746 | 464765 | AATGAAATAATTTCTACCTA | 55 | 2898 |
| 1040716 | N/A | N/A | 16822 | 16841 | GGCACATTTTAAAAGAAGC | 23 | 2899 |
| 1040748 | N/A | N/A | 30745 | 30764 | TGTTTGCTATTTTAAGAGCC | 24 | 2900 |
| 1040780 | N/A | N/A | 48620 | 48639 | GCTAGTAAAATTTAGGGCAG | 36 | 2901 |
| 1040812 | N/A | N/A | 76786 | 76805 | TCTGAAAACCTCTTCCTCT | 60 | 2902 |
| 1040844 | N/A | N/A | 93297 | 93316 | GATGCATTTCATTACTGCTT | 41 | 2903 |
| 1040876 | N/A | N/A | 114844 | 114863 | ATGTAATATTAAATAGCATC | 70 | 2904 |
| 1040908 | N/A | N/A | 148861 149972 | 148880 149991 | AGGTAATTTCAAAGCTTCCA | 4 | 2905 |
| 1040940 | N/A | N/A | 175616 | 175635 | CTTTCAATTCCTTAAAAGGA | 101 | 2906 |
| 1040972 | N/A | N/A | 195063 | 195082 | ACACACAAAGAATGAACCAT | 57 | 2907 |
| 1041004 | N/A | N/A | 212966 | 212985 | ATCCTAATTCAAAAACTAGT | 131 | 2908 |
| 1041036 | N/A | N/A | 235568 | 235587 | AGCCATAAAACCATGCGGTT | 91 | 2909 |
| 1041068 | N/A | N/A | 256941 | 256960 | TTACCCAAATTATCACTGTA | 47 | 2910 |
| 1041100 | N/A | N/A | 274711 | 274730 | GGACTTAACCCTTACTCCAA | 84 | 2911 |
| 1041132 | N/A | N/A | 293412 | 293431 | TGTTAGCTATTTTATATGGA | 2 | 2912 |
| 1041164 | N/A | N/A | 323174 | 323193 | TTACACAGCCAAAAACCCAT | 100 | 2913 |
| 1041196 | N/A | N/A | 344505 | 344524 | TGAGTAATTTAAAATGCCCA | 43 | 2914 |

TABLE 39-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041228 | N/A | N/A | 369876 | 369895 | AAGGTCTGCCTTTAACATTT | 14 | 2915 |
| 1041260 | N/A | N/A | 392003 | 392022 | GTAAAATTTCTTTATGTGTG | 4 | 2916 |
| 1041292 | N/A | N/A | 424647 | 424666 | AGTCTTAAAACTATTCACTG | 78 | 2917 |
| 1041324 | N/A | N/A | 437831 | 437850 | TCAAGGACTCCATAACTAGC | 111 | 2918 |
| 1041356 | N/A | N/A | 438263 | 438282 | GCTGATCTATCTGTTGGCCT | 58 | 2919 |
| 1041388 | N/A | N/A | 438882 | 438901 | TAGGGCTGCCTTCCATCTGT | 51 | 2920 |
| 1041420 | N/A | N/A | 439156 | 439175 | GCTGACTTTACCCCAAGCCC | 100 | 2921 |
| 1041452 | N/A | N/A | 439834 | 439853 | AATGCTCAAAAAGCCAGAC | 54 | 2922 |
| 1041484 | N/A | N/A | 440190 | 440209 | CTGTGAAGAGTCAACTTTGC | 65 | 2923 |
| 1041516 | N/A | N/A | 440724 | 440743 | CGCCTACAATCCCAGCTTTA | 93 | 2924 |
| 1041548 | N/A | N/A | 441358 | 441377 | GGAAGATTCTTCAGGCTAGG | 11 | 2925 |
| 1041580 | N/A | N/A | 441624 | 441643 | GTCTGTCACCACCATACTAT | 34 | 2926 |
| 1041612 | N/A | N/A | 442271 | 442290 | CCCAAACTAAACACCCCTCA | 97 | 2927 |
| 1041644 | N/A | N/A | 442787 | 442806 | AGCCCCATCCTTCTTTTGAG | 88 | 2928 |
| 1041676 | N/A | N/A | 443103 | 443122 | CGAGGATTACAGGCAGGGTA | 15 | 2929 |
| 1041708 | N/A | N/A | 443511 | 443530 | CGTGTCAACCCAGAGCACTT | 120 | 2930 |
| 1041740 | N/A | N/A | 443969 | 443988 | AGTCACCAACTATCTATTTT | 53 | 2931 |
| 1041772 | N/A | N/A | 444356 | 444375 | TCAGTTGTAACCAATCTATC | 20 | 2932 |
| 1041804 | N/A | N/A | 445269 | 445288 | GCCTCCTAACACAAATCCCA | 93 | 2933 |
| 1041836 | N/A | N/A | 445626 | 445645 | GCGAAATTATTAAATTGGGC | 50 | 2934 |
| 1041868 | N/A | N/A | 445900 | 445919 | TGATTGTATATTTCAATCTT | 114 | 2935 |
| 1041900 | N/A | N/A | 446090 | 446109 | GGAGACAACACCGACTCACT | 81 | 2936 |
| 1041932 | N/A | N/A | 446710 | 446729 | TTTCAAACACCCTAAGCAGT | 92 | 2937 |
| 1041964 | N/A | N/A | 446938 | 446957 | GAATCACACTTCAGTTATTT | 19 | 2938 |
| 1041996 | N/A | N/A | 447713 | 447732 | CCATCCTGCCAAAAAATCTT | 111 | 2939 |
| 1042028 | N/A | N/A | 448519 | 448538 | CCCCTTACTCCCTACACTGT | 95 | 2940 |
| 1042060 | N/A | N/A | 448773 | 448792 | CCCATGTTCTTCCCCATCTC | 70 | 2941 |
| 1042092 | N/A | N/A | 449077 | 449096 | CCGGCCTCAAAATATTATTG | 114 | 2942 |
| 1042124 | N/A | N/A | 449672 | 449691 | AAGGATATAAACATTCTTAA | 73 | 2943 |
| 1042156 | N/A | N/A | 449935 | 449954 | AGCGGAAGATTATTCAGATA | 18 | 2944 |
| 1042188 | N/A | N/A | 450567 | 450586 | CCAAATCTCCAAAGACAGGC | 54 | 2945 |
| 1042220 | N/A | N/A | 451224 | 451243 | ACTGGTGCCCAAATGTCTAT | 54 | 2946 |
| 1042252 | N/A | N/A | 451679 | 451698 | GCATCTCAAAACTCCAAAGA | 31 | 2947 |
| 1042284 | N/A | N/A | 451940 | 451959 | TGTGTGAGCCACATTATACA | 86 | 2948 |
| 1042316 | N/A | N/A | 452275 | 452294 | CTCCATAGATCCTCTTGCAA | 106 | 2949 |
| 1042348 | N/A | N/A | 452589 | 452608 | AAGAGATGAACTAAGCATTC | 52 | 2950 |

TABLE 39-continued

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
| --- | --- | --- | --- | --- | --- | --- | --- |
| 1042380 | N/A | N/A | 453101 | 453120 | GTTGCTTTTCTACTTCATCT | 21 | 2951 |
| 1042412 | N/A | N/A | 453897 | 453916 | TCTAGAACAAAATACATATT | 131 | 2952 |
| 1042444 | N/A | N/A | 455045 | 455064 | ATCCATGAAGCCAGGCATGG | 165 | 2953 |
| 1042476 | N/A | N/A | 455318 | 455337 | CATCTGAGTCCCTAAAACTG | 93 | 2954 |
| 1042508 | N/A | N/A | 456623 | 456642 | GTCCCCAGCCCCTAAAAGGA | 101 | 2955 |
| 1042540 | N/A | N/A | 457036 | 457055 | CAGGTATGAACTCACACAGA | 56 | 2956 |

TABLE 40

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
| --- | --- | --- | --- | --- | --- | --- | --- |
| 994605 | N/A | N/A | 17726 | 17745 | GTCACCTTTTCTATTTGCAC | 3 | 138 |
| 1040109 | 2741 | 2760 | 437460 | 437479 | CTTCTGTTTTAAGTCTTCC | 30 | 2957 |
| 1040141 | 3213 | 3232 | 457466 | 457485 | GCAGGCAATCCCATTTTCTC | 78 | 2958 |
| 1040173 | 4010 | 4029 | 458263 | 458282 | GGAGAGAAAAATGTTCTTTT | 5 | 2959 |
| 1040205 | 4497 | 4516 | 458750 | 458769 | GCTCATCTTCAAAATCTAAT | 9 | 2960 |
| 1040237 | 4758 | 4777 | 459011 | 459030 | ATTTATTGTCACATACTAGT | 76 | 2961 |
| 1040269 | 5216 | 5235 | 459469 | 459488 | CACATATATAAATGTCTTTA | 28 | 2962 |
| 1040301 | 5533 | 5552 | 459786 | 459805 | GAAAGTACTATTTTCAATGG | 27 | 2963 |
| 1040333 | 5959 | 5978 | 460212 | 460231 | ATGAGTTGTAAATAGTGATA | 22 | 2964 |
| 1040365 | 6440 | 6459 | 460693 | 460712 | ACTGCGGTTCCTCCCCCGGG | 111 | 2965 |
| 1040397 | 7126 | 7145 | 461379 | 461398 | AGTCATTTTATATATTTAGA | 58 | 2966 |
| 1040429 | 7601 | 7620 | 461854 | 461873 | GAAATCCAAACATTCCTTGA | 51 | 2967 |
| 1040461 | 8061 | 8080 | 462314 | 462333 | GCCCTGTTTTCACCTGGTGC | 57 | 2968 |
| 1040493 | 8325 | 8344 | 462578 | 462597 | TTTCCCTATGCCAGAAACAC | 63 | 2969 |
| 1040525 | 8685 | 8704 | 462938 | 462957 | TTCTATATACAAAAAAACAT | 107 | 2970 |
| 1040557 | 9101 | 9120 | 463354 | 463373 | TCCCCCCATTTAAATGAGGT | 145 | 2971 |
| 1040589 | 9439 | 9458 | 463692 | 463711 | CACTTAATTTTAATACAGTT | 44 | 2972 |
| 1040621 | 9883 | 9902 | 464136 | 464155 | GCAGTATTCACAGAACTGAA | 61 | 2973 |
| 1040653 | 10237 | 10256 | 464490 | 464509 | GCACTTAAAATTTTCTTTTC | 17 | 2974 |
| 1040685 | 10507 | 10526 | 464760 | 464779 | TGTTTTATTATAATAATGAA | 157 | 2975 |
| 1040717 | N/A | N/A | 17529 | 17548 | ACATCAAAACGATTTCTACT | 25 | 2976 |
| 1040749 | N/A | N/A | 31007 | 31026 | AACCAAAACCAAAAGCCTCT | 51 | 2977 |
| 1040781 | N/A | N/A | 48839 | 48858 | AATCTAAAATACATCTGCAT | 103 | 2978 |

TABLE 40-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040813 | N/A | N/A | 77220 | 77239 | CAGTTTATTTAAAGATATAA | 119 | 2979 |
| 1040845 | N/A | N/A | 94390 | 94409 | ATCAGTAAAGAATTGATGTC | 115 | 2980 |
| 1040877 | N/A | N/A | 114917 | 114936 | CTTCATAAAATTCCATTCTG | 26 | 2981 |
| 1040909 | N/A | N/A | 148914 150025 | 148933 150044 | GCTTTCATAATATAACAACC | 6 | 2982 |
| 1040941 | N/A | N/A | 176494 | 176513 | ATCAACAAAATTATGTATGG | 124 | 2983 |
| 1040973 | N/A | N/A | 195332 | 195351 | GGAAACAACCAAAGTTTTTT | 58 | 2984 |
| 1041005 | N/A | N/A | 213451 | 213470 | CTGTAGTTTTAAAAGTGCCT | 15 | 2985 |
| 1041037 | N/A | N/A | 236934 | 236953 | ACCATATTTCTTTAGAAGGT | 70 | 2986 |
| 1041069 | N/A | N/A | 257007 | 257026 | GTGACCAAAATACATATACT | 47 | 2987 |
| 1041101 | N/A | N/A | 274862 | 274881 | ACTGGATTTATTTAAGTCTT | 96 | 2988 |
| 1041133 | N/A | N/A | 294752 | 294771 | GAGTCTTGCCCTTAAGAAGC | 4 | 2989 |
| 1041165 | N/A | N/A | 323691 | 323710 | TTGATATTTCAAAAGAGCTA | 45 | 2990 |
| 1041197 | N/A | N/A | 344706 | 344725 | ATGTAAATATTTTAGCACAG | 3 | 2991 |
| 1041229 | N/A | N/A | 370271 | 370290 | GACTAATTTTAAAATATGCT | 36 | 2992 |
| 1041261 | N/A | N/A | 392692 | 392711 | GAGATAAAAATTATGTAGTT | 86 | 2993 |
| 1041293 | N/A | N/A | 425116 | 425135 | TGGGATAATATTTATAAGTG | 43 | 2994 |
| 1041325 | N/A | N/A | 437884 | 437903 | ATCTTAATCACAGAATTCAA | 46 | 2995 |
| 1041357 | N/A | N/A | 438268 | 438287 | TGTCTGCTGATCTATCTGTT | 14 | 2996 |
| 1041389 | N/A | N/A | 438883 | 438902 | TTAGGGCTGCCTTCCATCTG | 58 | 2997 |
| 1041421 | N/A | N/A | 439158 | 439177 | CAGCTGACTTTACCCCAAGC | 77 | 2998 |
| 1041453 | N/A | N/A | 439844 | 439863 | GCATTTAAGAAATGCTCAAA | 132 | 2999 |
| 1041485 | N/A | N/A | 440217 | 440236 | GTTTATTTTCCATGTGTCAC | 2 | 3000 |
| 1041517 | N/A | N/A | 440772 | 440791 | CTCCCCAAGAACAGAAGAGG | 149 | 3001 |
| 1041549 | N/A | N/A | 441359 | 441378 | AGGAAGATTCTTCAGGCTAG | 17 | 3002 |
| 1041581 | N/A | N/A | 441646 | 441665 | AGACCCAAATCCGCACCCCT | 134 | 3003 |
| 1041613 | N/A | N/A | 442273 | 442292 | TCCCCAAACTAAACACCCCT | 106 | 3004 |
| 1041645 | N/A | N/A | 442814 | 442833 | TACTTCCTACCCAAGGAGGA | 124 | 3005 |
| 1041677 | N/A | N/A | 443114 | 443133 | GGATTCCACCCCGAGGATTA | 120 | 3006 |
| 1041709 | N/A | N/A | 443555 | 443574 | CCCTAATAACACAGAGCCTG | 113 | 3007 |
| 1041741 | N/A | N/A | 443971 | 443990 | GCAGTCACCAACTATCTATT | 47 | 3008 |
| 1041773 | N/A | N/A | 444357 | 444376 | ATCAGTTGTAACCAATCTAT | 16 | 3009 |
| 1041805 | N/A | N/A | 445298 | 445317 | TCAGTAAACCCACACCCTAG | 109 | 3010 |
| 1041837 | N/A | N/A | 445627 | 445646 | GGCGAAATTATTAAATTGGG | 100 | 3011 |
| 1041869 | N/A | N/A | 445902 | 445921 | TTTGATTGTATATTTCAATC | 85 | 3012 |
| 1041901 | N/A | N/A | 446109 | 446128 | GATGGACGAACCTAGACAGG | 54 | 3013 |
| 1041933 | N/A | N/A | 446716 | 446735 | ATCCTGTTTCAAACACCCTA | 27 | 3014 |

TABLE 40-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041965 | N/A | N/A | 446945 | 446964 | TTTTATTGAATCACACTTCA | 41 | 3015 |
| 1041997 | N/A | N/A | 447722 | 447741 | TCCCTCTTCCCATCCTGCCA | 89 | 3016 |
| 1042029 | N/A | N/A | 448526 | 448545 | GCATGTGCCCCTTACTCCCT | 84 | 3017 |
| 1042061 | N/A | N/A | 448774 | 448793 | TCCCATGTTCTTCCCCATCT | 72 | 3018 |
| 1042093 | N/A | N/A | 449386 | 449405 | AGCTTCAAAATATTGTTATT | 53 | 3019 |
| 1042125 | N/A | N/A | 449674 | 449693 | ATAAGGATATAAACATTCTT | 59 | 3020 |
| 1042157 | N/A | N/A | 449937 | 449956 | GGAGCGGAAGATTATTCAGA | 33 | 3021 |
| 1042189 | N/A | N/A | 450569 | 450588 | CTCCAAATCTCCAAAGACAG | 86 | 3022 |
| 1042221 | N/A | N/A | 451237 | 451256 | TTCTTGAACCCTCACTGGTG | 100 | 3023 |
| 1042253 | N/A | N/A | 451681 | 451700 | CCGCATCTCAAAACTCCAAA | 9 | 3024 |
| 1042285 | N/A | N/A | 451942 | 451961 | GGTGTGTGAGCCACATTATA | 47 | 3025 |
| 1042317 | N/A | N/A | 452277 | 452296 | GGCTCCATAGATCCTCTTGC | 95 | 3026 |
| 1042349 | N/A | N/A | 452631 | 452650 | TGACCTCTACCCTTGTGAGC | 47 | 3027 |
| 1042381 | N/A | N/A | 453102 | 453121 | TGTTGCTTTTCTACTTCATC | 73 | 3028 |
| 1042413 | N/A | N/A | 453898 | 453917 | CTCTAGAACAAAATACATAT | 88 | 3029 |
| 1042445 | N/A | N/A | 455059 | 455078 | TCTGTTTTTAAAAGATCCAT | 36 | 3030 |
| 1042477 | N/A | N/A | 455353 | 455372 | AACAGGCCTTTCAAGGTCTG | 123 | 3031 |
| 1042509 | N/A | N/A | 456640 | 456659 | AGTGTGTTTATCACTGAGTC | 97 | 3032 |
| 1042541 | N/A | N/A | 457060 | 457079 | CTTGTTTGATTTTATGCACA | 92 | 3033 |

TABLE 41

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 2 | 138 |
| 1040110 | 2743 | 2762 | 437462 | 437481 | ATCTTCTGTTTTTAAGTCTT | 41 | 3034 |
| 1040142 | 3214 | 3233 | 457467 | 457486 | TGCAGGCAATCCCATTTTCT | 99 | 3035 |
| 1040174 | 4012 | 4031 | 458265 | 458284 | TTGGAGAGAAAAATGTTCTT | 23 | 3036 |
| 1040206 | 4499 | 4518 | 458752 | 458771 | ATGCTCATCTTCAAAATCTA | 23 | 3037 |
| 1040238 | 4763 | 4782 | 459016 | 459035 | TGGTCATTTATTGTCACATA | 6 | 3038 |
| 1040270 | 5220 | 5239 | 459473 | 459492 | TGCTCACATATATAAATGTC | 36 | 3039 |
| 1040302 | 5570 | 5589 | 459823 | 459842 | GTTGATACCAGATTTTTTTT | 30 | 3040 |
| 1040334 | 6015 | 6034 | 460268 | 460287 | AGTCAATTCAATACTCGAAG | 6 | 3041 |
| 1040366 | 6474 | 6493 | 460727 | 460746 | TCCACATTCACTATTCCGTG | 17 | 3042 |

TABLE 41-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040398 | 7128 | 7147 | 461381 | 461400 | ACAGTCATTTTATATATTTA | 34 | 3043 |
| 1040430 | 7604 | 7623 | 461857 | 461876 | CAGGAAATCCAAACATTCCT | 130 | 3044 |
| 1040462 | 8106 | 8125 | 462359 | 462378 | TCACATCACCACCGAAGAAA | 40 | 3045 |
| 1040494 | 8331 | 8350 | 462584 | 462603 | TTGGAGTTTCCCTATGCCAG | 17 | 3046 |
| 1040526 | 8692 | 8711 | 462945 | 462964 | GACAAATTTCTATATACAAA | 57 | 3047 |
| 1040558 | 9103 | 9122 | 463356 | 463375 | ACTCCCCCCATTTAAATGAG | 116 | 3048 |
| 1040590 | 9440 | 9459 | 463693 | 463712 | GCACTTAATTTTAATACAGT | 15 | 3049 |
| 1040622 | 9884 | 9903 | 464137 | 464156 | GGCAGTATTCACAGAACTGA | 41 | 3050 |
| 1040654 | 10253 | 10272 | 464506 | 464525 | CTTAACTATTATGTATGCAC | 17 | 3051 |
| 1040686 | 10508 | 10527 | 464761 | 464780 | TTGTTTTATTATAATAATGA | 195 | 3052 |
| 1040718 | N/A | N/A | 17546 | 17565 | GCAGGTAAAACCAAATGACA | 121 | 3053 |
| 1040750 | N/A | N/A | 31009 | 31028 | GCAACCAAAACCAAAAGCCT | 67 | 3054 |
| 1040782 | N/A | N/A | 49205 | 49224 | GGGCTATTAATTTATTAAAT | 123 | 3055 |
| 1040814 | N/A | N/A | 77279 | 77298 | AAGATCTTTTAAAGTCCTAC | 58 | 3056 |
| 1040846 | N/A | N/A | 94692 | 94711 | GTAAGCTCCATTTATAGAAT | 30 | 3057 |
| 1040878 | N/A | N/A | 117437 | 117456 | CCTCACACACCTTAACCCTG | 95 | 3058 |
| 1040910 | N/A | N/A | 151015 | 151034 | GAGATAAAATTATTTTGGC | 108 | 3059 |
| 1040942 | N/A | N/A | 176706 | 176725 | GCTAAATTTCATTAGAAACA | 115 | 3060 |
| 1040974 | N/A | N/A | 195854 | 195873 | TTTTCTACAATTTATAGGCG | 27 | 3061 |
| 1041006 | N/A | N/A | 215585 | 215604 | CTGCACCAAATTTATTTTTG | 37 | 3062 |
| 1041038 | N/A | N/A | 237026 | 237045 | ACTGAAAAACTGTATGATC | 99 | 3063 |
| 1041070 | N/A | N/A | 257572 | 257591 | CCTTTTAAAATTTCCAGAAA | 97 | 3064 |
| 1041102 | N/A | N/A | 276104 | 276123 | GAAGTTAGCCAGGCATCAGG | 77 | 3065 |
| 1041134 | N/A | N/A | 294914 | 294933 | GCAGAGTTTTAAAATGCACT | 14 | 3066 |
| 1041166 | N/A | N/A | 324245 | 324264 | AGGCATAGTATTTAGCAGAA | 2 | 3067 |
| 1041198 | N/A | N/A | 345616 | 345635 | TACTTCTTTCCTTAAGCACA | 6 | 3068 |
| 1041230 | N/A | N/A | 370434 | 370453 | TAGTTTAAAATATGTGACTC | 96 | 3069 |
| 1041262 | N/A | N/A | 393162 | 393181 | CCAGAAAAACCTTAAACTAC | 73 | 3070 |
| 1041294 | N/A | N/A | 425225 | 425244 | ACCTTCAAACTATCAATTCT | 105 | 3071 |
| 1041326 | N/A | N/A | 437890 | 437909 | TTCCTCATCTTAATCACAGA | 25 | 3072 |
| 1041358 | N/A | N/A | 438300 | 438319 | GAGAGTATAAAAATTATCTC | 102 | 3073 |
| 1041390 | N/A | N/A | 438894 | 438913 | GTCCATCACACTTAGGGCTG | 37 | 3074 |
| 1041422 | N/A | N/A | 439161 | 439180 | CTACAGCTGACTTTACCCCA | 50 | 3075 |
| 1041454 | N/A | N/A | 439848 | 439867 | TTGGGCATTTAAGAAATGCT | 116 | 3076 |
| 1041486 | N/A | N/A | 440219 | 440238 | ATGTTTATTTTCCATGTGTC | 3 | 3077 |
| 1041518 | N/A | N/A | 440776 | 440795 | CTTCCTCCCCAAGAACAGAA | 88 | 3078 |

TABLE 41-continued

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041550 | N/A | N/A | 441384 | 441403 | CAGTGCCTAACCAGTTGAGA | 28 | 3079 |
| 1041582 | N/A | N/A | 441650 | 441669 | CCAGAGACCCAAATCCGCAC | 65 | 3080 |
| 1041614 | N/A | N/A | 442275 | 442294 | CATCCCCAAACTAAACACCC | 95 | 3081 |
| 1041646 | N/A | N/A | 442820 | 442839 | CTAACCTACTTCCTACCCAA | 133 | 3082 |
| 1041678 | N/A | N/A | 443164 | 443183 | AGCCTTAGAAACAGGAACGG | 46 | 3083 |
| 1041710 | N/A | N/A | 443556 | 443575 | GCCCTAATAACACAGAGCCT | 142 | 3084 |
| 1041742 | N/A | N/A | 444005 | 444024 | CGGCACAAATCCAGGGCTGG | 87 | 3085 |
| 1041774 | N/A | N/A | 444387 | 444406 | TAGTTAAAAATAAGGTATCG | 87 | 3086 |
| 1041806 | N/A | N/A | 445299 | 445318 | TTCAGTAAACCCACACCCTA | 110 | 3087 |
| 1041838 | N/A | N/A | 445628 | 445647 | TGGCGAAATTATTAAATTGG | 102 | 3088 |
| 1041870 | N/A | N/A | 445919 | 445938 | CACGCATATTTATGCTGTTT | 86 | 3089 |
| 1041902 | N/A | N/A | 446110 | 446129 | GGATGGACGAACCTAGACAG | 34 | 3090 |
| 1041934 | N/A | N/A | 446718 | 446737 | ATATCCTGTTTCAAACACCC | 43 | 3091 |
| 1041966 | N/A | N/A | 446947 | 446966 | GATTTTATTGAATCACACTT | 19 | 3092 |
| 1041998 | N/A | N/A | 447903 | 447922 | CAACCATTCCAGACTGAGCT | 109 | 3093 |
| 1042030 | N/A | N/A | 448548 | 448567 | ACATGCAAGCCTGATGTGGT | 121 | 3094 |
| 1042062 | N/A | N/A | 448818 | 448837 | CTAAAACACACCAGACCTCC | 91 | 3095 |
| 1042094 | N/A | N/A | 449387 | 449406 | TAGCTTCAAAATATTGTTAT | 62 | 3096 |
| 1042126 | N/A | N/A | 449684 | 449703 | TAGGTTTGTCATAAGGATAT | 11 | 3097 |
| 1042158 | N/A | N/A | 449978 | 449997 | GCCACGACCAGATATCAGCT | 39 | 3098 |
| 1042190 | N/A | N/A | 450570 | 450589 | ACTCCAAATCTCCAAAGACA | 95 | 3099 |
| 1042222 | N/A | N/A | 451238 | 451257 | CTTCTTGAACCCTCACTGGT | 119 | 3100 |
| 1042254 | N/A | N/A | 451682 | 451701 | TCCGCATCTCAAAACTCCAA | 28 | 3101 |
| 1042286 | N/A | N/A | 451968 | 451987 | GGACACCTACCCATGGAGAG | 57 | 3102 |
| 1042318 | N/A | N/A | 452311 | 452330 | ACTGTATTCTAAGTAGGAGG | 23 | 3103 |
| 1042350 | N/A | N/A | 452636 | 452655 | CCTCCTGACCTCTACCCTTG | 77 | 3104 |
| 1042382 | N/A | N/A | 453115 | 453134 | GATTTCCACAGATTGTTGCT | 66 | 3105 |
| 1042414 | N/A | N/A | 453899 | 453918 | CCTCTAGAACAAAATACATA | 36 | 3106 |
| 1042446 | N/A | N/A | 455060 | 455079 | ATCTGTTTTTAAAAGATCCA | 71 | 3107 |
| 1042478 | N/A | N/A | 455364 | 455383 | AACCACAAGCCAACAGGCCT | 114 | 3108 |
| 1042510 | N/A | N/A | 456663 | 456682 | TGTGAGTTCCAAGAAGCAGG | 54 | 3109 |
| 1042542 | N/A | N/A | 457069 | 457088 | CATTTTATTCTTGTTTGATT | 149 | 3110 |

TABLE 42

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 2 | 138 |
| 994630 | N/A | N/A | 85516 | 85535 | GTTTGATATGCTATGCTCAC | 12 | 219 |
| 994693 | N/A | N/A | 184184 | 184203 | TCAGGTTTATATGTATACAA | 2 | 149 |
| 994706 | N/A | N/A | 217284 | 217303 | GTTATGTTTAAGGTATTTTC | 5 | 540 |
| 994735 | N/A | N/A | 297005 | 297024 | GTTTGCATTAAATGACTGTG | 1 | 310 |
| 1054946 | 101 | 120 | 2611 | 2630 | CTGTTGCTCTGGCTGCTGCT | 10 | 3111 |
| 1054950 | 110 | 129 | 2620 | 2639 | TTGCGGCTGCTGTTGCTCTG | 14 | 3112 |
| 1054955 | 117 | 136 | 2627 | 2646 | CAATGTCTTGCGGCTGCTGT | 24 | 3113 |
| 1054966 | 248 | 267 | 10659 | 10678 | CCTGGTGACTTGATGCACGA | 25 | 3114 |
| 1054972 | 552 | 571 | 178162 | 178181 | ATCAGTTCCTTGCAGCAGAT | 3 | 3115 |
| 1054978 | 561 | 580 | 178171 | 178190 | CCATAAGCTATCAGTTCCTT | 2 | 3116 |
| 1054983 | 568 | 587 | 178178 | 178197 | TGGAGAACCATAAGCTATCA | 8 | 3117 |
| 1054989 | 586 | 605 | 178196 | 178215 | CATGTGCTTTCATCACAATG | 63 | 3118 |
| 1054994 | 592 | 611 | 178202 | 178221 | CTGTACCATGTGCTTTCATC | 2 | 3119 |
| 1055000 | 3487 | 3506 | 457740 | 457759 | TAAATACTGTGTTATTTTAG | 72 | 3120 |
| 1055004 | 5497 | 5516 | 459750 | 459769 | GGTATTTGTTCAGTTTAGTT | 6 | 3121 |
| 1055008 | 5503 | 5522 | 459756 | 459775 | AAGTCAGGTATTTGTTCAGT | 5 | 3122 |
| 1055014 | 6028 | 6047 | 460281 | 460300 | GTTTAGTGGATCCAGTCAAT | 16 | 3123 |
| 1055018 | 6035 | 6054 | 460288 | 460307 | AGTGTTGGTTTAGTGGATCC | 32 | 3124 |
| 1055023 | 6044 | 6063 | 460297 | 460316 | TCCCATCTTAGTGTTGGTTT | 28 | 3125 |
| 1055029 | 9484 | 9503 | 463737 | 463756 | TTAGAGATTGTTGTTATTGT | 13 | 3126 |
| 1055034 | 9490 | 9509 | 463743 | 463762 | AAATTCTTAGAGATTGTTGT | 14 | 3127 |
| 1055039 | 10090 | 10109 | 464343 | 464362 | TGATCTGATATTAAAACATC | 78 | 3128 |
| 1055044 | 10097 | 10116 | 464350 | 464369 | TGGGTAATGATCTGATATTA | 13 | 3129 |
| 1055050 | 10106 | 10125 | 464359 | 464378 | GGCATATGGTGGGTAATGAT | 12 | 3130 |
| 1055056 | 196 | 215 | 9912 | 9931 | AGTAGTTTTTGTGAGGTAAA | 11 | 3131 |
| 1055060 | 202 | 221 | 9918 | 9937 | GCTTGTAGTAGTTTTTGTGA | 29 | 3132 |
| 1055064 | N/A | N/A | 17720 | 17739 | TTTTCTATTTGCACTAGCTG | 65 | 3133 |
| 1055070 | N/A | N/A | 17728 | 17747 | ATGTCACCTTTTCTATTTGC | 3 | 3134 |
| 1055076 | N/A | N/A | 24689 | 24708 | AAACACTAGAAATCCAGGGA | 7 | 3135 |
| 1055082 | N/A | N/A | 85508 | 85527 | TGCTATGCTCACAGAGAACC | 78 | 3136 |
| 1055093 | N/A | N/A | 85524 | 85543 | TACAGTTAGTTTGATATGCT | 25 | 3137 |
| 1055098 | N/A | N/A | 108194 | 108213 | GGAATAAATTATTTACTGCG | 5 | 3138 |
| 1055104 | N/A | N/A | 148323 149434 | 148342 149453 | TACTATGTATTTGCCACAGT | 6 | 3139 |
| 1055110 | N/A | N/A | 179786 | 179805 | ATATTTAATCATGTTCCCGA | 13 | 3140 |
| 1055115 | N/A | N/A | 179792 | 179811 | ATAGTTATATTTAATCATGT | 67 | 3141 |

TABLE 42-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1055120 | N/A | N/A | 184176 | 184195 | ATATGTATACAATTCTGACA | 38 | 3142 |
| 1055131 | N/A | N/A | 184192 | 184211 | CAATGTTCTCAGGTTTATAT | 15 | 3143 |
| 1055137 | N/A | N/A | 203033 | 203052 | CCTTTCTTCTTTGTTCATAG | 6 | 3144 |
| 1055142 | N/A | N/A | 203039 | 203058 | CTTGTTCCTTTCTTCTTTGT | 31 | 3145 |
| 1055148 | N/A | N/A | 203883 | 203902 | ATTTATCCTCAGGATGCAAA | 55 | 3146 |
| 1055154 | N/A | N/A | 203892 | 203911 | TTTGTTTAGATTTATCCTCA | 6 | 3147 |
| 1055159 | N/A | N/A | 210724 | 210743 | ATACTCCATTTTCCTTCTA | 19 | 3148 |
| 1055164 | N/A | N/A | 210731 | 210750 | ATGTGTAATACTCCATTTTT | 25 | 3149 |
| 1055170 | N/A | N/A | 210740 | 210759 | TTATTACAAATGTGTAATAC | 107 | 3150 |
| 1055176 | N/A | N/A | 212029 | 212048 | TATGTTAGTCATTTCTCTCT | 28 | 3151 |
| 1055181 | N/A | N/A | 212035 | 212054 | CAAGTCTATGTTAGTCATTT | 10 | 3152 |
| 1055187 | N/A | N/A | 217276 | 217295 | TAAGGTATTTTCATGGAGTT | 12 | 3153 |
| 1055198 | N/A | N/A | 217292 | 217311 | TTGTAACAGTTATGTTTAAG | 43 | 3154 |
| 1055204 | N/A | N/A | 226990 | 227009 | TTTACTCATTCTACCTTCAA | 66 | 3155 |
| 1055209 | N/A | N/A | 226997 | 227016 | TTGGTTATTTACTCATTCTA | 20 | 3156 |
| 1055215 | N/A | N/A | 227006 | 227025 | TCCATAAACTTGGTTATTTA | 25 | 3157 |
| 1055221 | N/A | N/A | 251494 | 251513 | TTAGCTTTTCAAATACTAAA | 91 | 3158 |
| 1055227 | N/A | N/A | 251503 | 251522 | TCAGCATACTTAGCTTTTCA | 11 | 3159 |
| 1055232 | N/A | N/A | 251510 | 251529 | GACAGTGTCAGCATACTTAG | 12 | 3160 |
| 1055238 | N/A | N/A | 273793 | 273812 | TACCCAGGTTATTACACTGT | 116 | 3161 |
| 1055244 | N/A | N/A | 284229 | 284248 | TTGGGTTTTTCTGTACAAAG | 1 | 3162 |
| 1055249 | N/A | N/A | 284235 | 284254 | TTTTGTTTGGGTTTTCTGT | 1 | 3163 |
| 1055255 | N/A | N/A | 284335 | 284354 | CTAGTTCTTATCACTATTCA | 7 | 3164 |
| 1055260 | N/A | N/A | 284342 | 284361 | ATGTCAACTAGTTCTTATCA | 5 | 3165 |
| 1055266 | N/A | N/A | 284351 | 284370 | GACTAAACAATGTCAACTAG | 12 | 3166 |
| 1055272 | N/A | N/A | 291011 | 291030 | TGGGTTTTAGTTTTCCTTC | 4 | 3167 |
| 1055277 | N/A | N/A | 291017 | 291036 | AGGTCCTGGGTTTTTAGTTT | 3 | 3168 |
| 1055283 | N/A | N/A | 296997 | 297016 | TAAATGACTGTGGTGCAGCC | 9 | 3169 |
| 1055294 | N/A | N/A | 297013 | 297032 | AAGCCAGTGTTTGCATTAAA | 1 | 3170 |
| 1055300 | N/A | N/A | 306737 | 306756 | AAGGGCCACTAAATCTGACC | 22 | 3171 |
| 1055306 | N/A | N/A | 318477 | 318496 | ATTTCTTTTTTTTTAAGTT | 103 | 3172 |
| 1055311 | N/A | N/A | 318486 | 318505 | GTGTTTGATATTTCTTTTTT | 1 | 3173 |
| 1055317 | N/A | N/A | 318495 | 318514 | CTTTCAAATGTGTTTGATAT | 3 | 3174 |
| 1055323 | N/A | N/A | 332356 | 332375 | TTATAACAATTTGCATAGTC | 4 | 3175 |
| 1055328 | N/A | N/A | 332363 | 332382 | GGGAGTATTATAACAATTTG | 1 | 3176 |
| 1055334 | N/A | N/A | 332372 | 332391 | TATTTTCCAGGGAGTATTAT | 36 | 3177 |

TABLE 42-continued

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1055340 | N/A | N/A | 347819 | 347838 | CATTATCTAGTTTCTGGAAA | 28 | 3178 |
| 1055345 | N/A | N/A | 347825 | 347844 | AATGGTCATTATCTAGTTTC | 7 | 3179 |
| 1055351 | N/A | N/A | 353593 | 353612 | CTAAATCTGACTTACAAAGG | 121 | 3180 |
| 1055357 | N/A | N/A | 377459 | 377478 | TAAAACCAATACATTAACAT | 117 | 3181 |
| 1055363 | N/A | N/A | 410197 | 410216 | CATTATGCTTTAAGATCACA | 5 | 3182 |

TABLE 43

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994311 | 103 | 122 | 2613 | 2632 | TGCTGTTGCTCTGGCTGCTG | 33 | 257 |
| 994313 | 111 | 130 | 2621 | 2640 | CTTGCGGCTGCTGTTGCTCT | 14 | 413 |
| 994328 | 562 | 581 | 178172 | 178191 | ACCATAAGCTATCAGTTCCT | 2 | 337 |
| 994599 | 204 | 223 | 9920 | 9939 | GTGCTTGTAGTAGTTTTTGT | 23 | 293 |
| 994605 | N/A | N/A | 17726 | 17745 | GTCACCTTTTCTATTTGCAC | 1 | 138 |
| 994701 | N/A | N/A | 203893 | 203912 | GTTTGTTTAGATTTATCCTC | 2 | 150 |
| 994717 | N/A | N/A | 251504 | 251523 | GTCAGCATACTTAGCTTTTC | 8 | 152 |
| 1040945 | N/A | N/A | 179793 | 179812 | CATAGTTATATTTAATCATG | 52 | 828 |
| 1054956 | 119 | 138 | 2629 | 2648 | AACAATGTCTTGCGGCTGCT | 24 | 3183 |
| 1054962 | 243 | 262 | 10654 | 10673 | TGACTTGATGCACGATGCTC | 10 | 3184 |
| 1054967 | 249 | 268 | 10660 | 10679 | CCCTGGTGACTTGATGCACG | 23 | 3185 |
| 1054973 | 554 | 573 | 178164 | 178183 | CTATCAGTTCCTTGCAGCAG | 3 | 3186 |
| 1054984 | 570 | 589 | 178180 | 178199 | AATGGAGAACCATAAGCTAT | 26 | 3187 |
| 1054990 | 587 | 606 | 178197 | 178216 | CCATGTGCTTTCATCACAAT | 20 | 3188 |
| 1054995 | 593 | 612 | N/A | N/A | ACTGTACCATGTGCTTTCAT | 1 | 3189 |
| 1055001 | 5489 | 5508 | 459742 | 459761 | TTCAGTTTAGTTGCAGCCAT | 7 | 3190 |
| 1055005 | 5498 | 5517 | 459751 | 459770 | AGGTATTTGTTCAGTTTAGT | 7 | 3191 |
| 1055009 | 5505 | 5524 | 459758 | 459777 | AAAAGTCAGGTATTTGTTCA | 15 | 3192 |
| 1055015 | 6030 | 6049 | 460283 | 460302 | TGGTTTAGTGGATCCAGTCA | 18 | 3193 |
| 1055019 | 6036 | 6055 | 460289 | 460308 | TAGTGTTGGTTTAGTGGATC | 23 | 3194 |
| 1055024 | 9476 | 9495 | 463729 | 463748 | TGTTGTTATTGTATAGATAC | 9 | 3195 |
| 1055030 | 9485 | 9504 | 463738 | 463757 | CTTAGAGATTGTTGTTATTG | 15 | 3196 |
| 1055035 | 9492 | 9511 | 463745 | 463764 | GGAAATTCTTAGAGATTGTT | 12 | 3197 |
| 1055040 | 10092 | 10111 | 464345 | 464364 | AATGATCTGATATTAAAACA | 43 | 3198 |

TABLE 43-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1055045 | 10098 | 10117 | 464351 | 464370 | GTGGGTAATGATCTGATATT | 13 | 3199 |
| 1055051 | 188 | 207 | N/A | N/A | TTGTGAGGTAAAACTGTAAA | 137 | 3200 |
| 1055057 | 197 | 216 | 9913 | 9932 | TAGTAGTTTTGTGAGGTAA | 12 | 3201 |
| 1055065 | N/A | N/A | 17722 | 17741 | CCTTTTCTATTTGCACTAGC | 28 | 3202 |
| 1055071 | N/A | N/A | 17729 | 17748 | AATGTCACCTTTTCTATTTG | 16 | 3203 |
| 1055077 | N/A | N/A | 36482 | 36501 | AACTCTCTTAAGTACTTATA | 16 | 3204 |
| 1055083 | N/A | N/A | 85510 | 85529 | TATGCTATGCTCACAGAGAA | 55 | 3205 |
| 1055088 | N/A | N/A | 85517 | 85536 | AGTTTGATATGCTATGCTCA | 8 | 3206 |
| 1055094 | N/A | N/A | 85526 | 85545 | CTTACAGTTAGTTTGATATG | 26 | 3207 |
| 1055099 | N/A | N/A | 125427 | 125446 | AGCTTCCAGATAAAACCTCC | 61 | 3208 |
| 1055105 | N/A | N/A | 179272 | 179291 | TTCAAAATTCTCAGCATTGG | 5 | 3209 |
| 1055111 | N/A | N/A | 179787 | 179806 | TATATTTAATCATGTTCCCG | 13 | 3210 |
| 1055121 | N/A | N/A | 184178 | 184197 | TTATATGTATACAATTCTGA | 67 | 3211 |
| 1055126 | N/A | N/A | 184185 | 184204 | CTCAGGTTTATATGTATACA | 1 | 3212 |
| 1055132 | N/A | N/A | 184194 | 184213 | GGCAATGTTCTCAGGTTTAT | 1 | 3213 |
| 1055138 | N/A | N/A | 203034 | 203053 | TCCTTTCTTCTTTGTTCATA | 9 | 3214 |
| 1055143 | N/A | N/A | 203040 | 203059 | TCTTGTTCCTTTCTTCTTTG | 20 | 3215 |
| 1055149 | N/A | N/A | 203885 | 203904 | AGATTTATCCTCAGGATGCA | 26 | 3216 |
| 1055160 | N/A | N/A | 210726 | 210745 | TAATACTCCATTTTTCCTTC | 25 | 3217 |
| 1055165 | N/A | N/A | 210732 | 210751 | AATGTGTAATACTCCATTTT | 51 | 3218 |
| 1055171 | N/A | N/A | 212021 | 212040 | TCATTTCTCTCTGGCTGTGC | 27 | 3219 |
| 1055177 | N/A | N/A | 212030 | 212049 | CTATGTTAGTCATTTCTCTC | 15 | 3220 |
| 1055182 | N/A | N/A | 212037 | 212056 | ATCAAGTCTATGTTAGTCAT | 11 | 3221 |
| 1055188 | N/A | N/A | 217278 | 217297 | TTTAAGGTATTTTCATGGAG | 7 | 3222 |
| 1055193 | N/A | N/A | 217285 | 217304 | AGTTATGTTTAAGGTATTTT | 53 | 3223 |
| 1055199 | N/A | N/A | 217294 | 217313 | ACTTGTAACAGTTATGTTTA | 44 | 3224 |
| 1055205 | N/A | N/A | 226992 | 227011 | TATTTACTCATTCTACCTTC | 63 | 3225 |
| 1055210 | N/A | N/A | 226998 | 227017 | CTTGGTTATTTACTCATTCT | 21 | 3226 |
| 1055216 | N/A | N/A | 228677 | 228696 | GGCTGATTCTAGTACTGTGA | 51 | 3227 |
| 1055222 | N/A | N/A | 251496 | 251515 | ACTTAGCTTTTCAAATACTA | 30 | 3228 |
| 1055233 | N/A | N/A | 251512 | 251531 | AGGACAGTGTCAGCATACTT | 14 | 3229 |
| 1055239 | N/A | N/A | 284221 | 284240 | TTCTGTACAAAGTTCAGTTG | 54 | 3230 |
| 1055245 | N/A | N/A | 284230 | 284249 | TTTGGGTTTTCTGTACAAA | <1 | 3231 |
| 1055250 | N/A | N/A | 284237 | 284256 | AGTTTGTTTGGGTTTTCT | <1 | 3232 |
| 1055256 | N/A | N/A | 284337 | 284356 | AACTAGTTCTTATCACTATT | 37 | 3233 |
| 1055261 | N/A | N/A | 284343 | 284362 | AATGTCAACTAGTTCTTATC | 2 | 3234 |

TABLE 43-continued

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1055267 | N/A | N/A | 288842 | 288861 | TATAAAATTCACCTAAAATT | 110 | 3235 |
| 1055273 | N/A | N/A | 291012 | 291031 | CTGGGTTTTAGTTTTCCTT | 1 | 3236 |
| 1055278 | N/A | N/A | 291018 | 291037 | TAGGTCCTGGGTTTTTAGTT | 3 | 3237 |
| 1055284 | N/A | N/A | 296999 | 297018 | ATTAAATGACTGTGGTGCAG | 3 | 3238 |
| 1055289 | N/A | N/A | 297006 | 297025 | TGTTTGCATTAAATGACTGT | 27 | 3239 |
| 1055295 | N/A | N/A | 297015 | 297034 | AAAAGCCAGTGTTTGCATTA | 2 | 3240 |
| 1055301 | N/A | N/A | 306738 306824 | 306757 306843 | TAAGGGCCACTAAATCTGAC | 12 | 3241 |
| 1055307 | N/A | N/A | 318479 | 318498 | ATATTTCTTTTTTTTTAAG | 134 | 3242 |
| 1055312 | N/A | N/A | 318487 | 318506 | TGTGTTTGATATTTCTTTTT | <1 | 3243 |
| 1055318 | N/A | N/A | 318632 | 318651 | ATGCAAGGTCCAGGGAATAC | 1 | 3244 |
| 1055324 | N/A | N/A | 332358 | 332377 | TATTATAACAATTTGCATAG | 46 | 3245 |
| 1055329 | N/A | N/A | 332364 | 332383 | AGGGAGTATTATAACAATTT | 1 | 3246 |
| 1055335 | N/A | N/A | 333552 | 333571 | TATGAGTAATTAGCACAAAG | 11 | 3247 |
| 1055341 | N/A | N/A | 347820 | 347839 | TCATTATCTAGTTTCTGGAA | 6 | 3248 |
| 1055346 | N/A | N/A | 347826 | 347845 | AAATGGTCATTATCTAGTTT | 5 | 3249 |
| 1055352 | N/A | N/A | 353767 | 353786 | ACTTCCAATTTTGAAATACT | 10 | 3250 |
| 1055358 | N/A | N/A | 389235 | 389254 | GAAAGCCCCAGCACATAAAT | 114 | 3251 |
| 1055364 | N/A | N/A | 420350 | 420369 | TGAAAGCTGGCCGATATCCC | 65 | 3252 |

TABLE 44

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994312 | 105 | 124 | 2615 | 2634 | GCTGCTGTTGCTCTGGCTGC | 48 | 335 |
| 994447 | 5491 | 5510 | 459744 | 459763 | TGTTCAGTTTAGTTGCAGCC | 12 | 274 |
| 994449 | 5499 | 5518 | 459752 | 459771 | CAGGTATTTGTTCAGTTTAG | 8 | 430 |
| 994561 | 9486 | 9505 | 463739 | 463758 | TCTTAGAGATTGTTGTTATT | 13 | 444 |
| 994597 | 198 | 217 | 9914 | 9933 | GTAGTAGTTTTTGTGAGGTA | 10 | 137 |
| 994601 | 206 | 225 | 9922 | 9941 | TGGTGCTTGTAGTAGTTTTT | 31 | 449 |
| 994605 | N/A | N/A | 17726 | 17745 | GTCACCTTTTCTATTTGCAC | 2 | 138 |
| 994703 | N/A | N/A | 212031 | 212050 | TCTATGTTAGTCATTTCTCT | 21 | 306 |
| 994731 | N/A | N/A | 284231 | 284250 | GTTTGGGTTTTTCTGTACAA | 2 | 621 |
| 1040848 | N/A | N/A | 96129 | 96148 | CACTTTCTAGATTATTCTTA | 102 | 748 |
| 1054951 | 112 | 131 | 2622 | 2641 | TCTTGCGGCTGCTGTTGCTC | 14 | 3253 |

TABLE 44-continued

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1054957 | 121 | 140 | 2631 | 2650 | GAAACAATGTCTTGCGGCTG | 15 | 3254 |
| 1054963 | 244 | 263 | 10655 | 10674 | GTGACTTGATGCACGATGCT | 8 | 3255 |
| 1054968 | 250 | 269 | 10661 | 10680 | ACCCTGGTGACTTGATGCAC | 20 | 3256 |
| 1054974 | 556 | 575 | 178166 | 178185 | AGCTATCAGTTCCTTGCAGC | 11 | 3257 |
| 1054979 | 563 | 582 | 178173 | 178192 | AACCATAAGCTATCAGTTCC | 7 | 3258 |
| 1054985 | 572 | 591 | 178182 | 178201 | ACAATGGAGAACCATAAGCT | 101 | 3259 |
| 1054991 | 588 | 607 | 178198 | 178217 | ACCATGTGCTTTCATCACAA | 3 | 3260 |
| 1054996 | 594 | 613 | N/A | N/A | AACTGTACCATGTGCTTTCA | 3 | 3261 |
| 1055010 | 5507 | 5526 | 459760 | 459779 | AGAAAAGTCAGGTATTTGTT | 14 | 3262 |
| 1055016 | 6031 | 6050 | 460284 | 460303 | TTGGTTTAGTGGATCCAGTC | 31 | 3263 |
| 1055020 | 6037 | 6056 | 460290 | 460309 | TTAGTGTTGGTTTAGTGGAT | 20 | 3264 |
| 1055025 | 9478 | 9497 | 463731 | 463750 | ATTGTTGTTATTGTATAGAT | 18 | 3265 |
| 1055036 | 9494 | 9513 | 463747 | 463766 | ATGGAAATTCTTAGAGATTG | 16 | 3266 |
| 1055041 | 10093 | 10112 | 464346 | 464365 | TAATGATCTGATATTAAAAC | 111 | 3267 |
| 1055046 | 10099 | 10118 | 464352 | 464371 | GGTGGGTAATGATCTGATAT | 34 | 3268 |
| 1055052 | 190 | 209 | N/A | N/A | TTTTGTGAGGTAAAACTGTA | 136 | 3269 |
| 1055066 | N/A | N/A | 17723 | 17742 | ACCTTTTCTATTTGCACTAG | 19 | 3270 |
| 1055072 | N/A | N/A | 17730 | 17749 | AAATGTCACCTTTTCTATTT | 56 | 3271 |
| 1055078 | N/A | N/A | 36986 | 37005 | GCTATTTTTTCCAGAAAGTC | 6 | 3272 |
| 1055084 | N/A | N/A | 85512 | 85531 | GATATGCTATGCTCACAGAG | 23 | 3273 |
| 1055089 | N/A | N/A | 85518 | 85537 | TAGTTTGATATGCTATGCTC | 33 | 3274 |
| 1055100 | N/A | N/A | 133992 | 134011 | AATTTTTTTTAACATCTTGC | 88 | 3275 |
| 1055106 | N/A | N/A | 179779 | 179798 | ATCATGTTCCCGATATTGGA | 15 | 3276 |
| 1055112 | N/A | N/A | 179788 | 179807 | TTATATTTAATCATGTTCCC | 11 | 3277 |
| 1055116 | N/A | N/A | 179795 | 179814 | AACATAGTTATATTTAATCA | 132 | 3278 |
| 1055122 | N/A | N/A | 184180 | 184199 | GTTTATATGTATACAATTCT | 26 | 3279 |
| 1055127 | N/A | N/A | 184186 | 184205 | TCTCAGGTTTATATGTATAC | 4 | 3280 |
| 1055133 | N/A | N/A | 187811 | 187830 | TCACAGGGAATAATGAAGAG | 73 | 3281 |
| 1055139 | N/A | N/A | 203035 | 203054 | TTCCTTTCTTCTTTGTTCAT | 45 | 3282 |
| 1055144 | N/A | N/A | 203041 | 203060 | CTCTTGTTCCTTTCTTCTTT | 20 | 3283 |
| 1055150 | N/A | N/A | 203887 | 203906 | TTAGATTTATCCTCAGGATG | 51 | 3284 |
| 1055155 | N/A | N/A | 203894 | 203913 | GGTTTGTTTAGATTTATCCT | 11 | 3285 |
| 1055161 | N/A | N/A | 210727 | 210746 | GTAATACTCCATTTTCCTT | 4 | 3286 |
| 1055166 | N/A | N/A | 210733 | 210752 | AAATGTGTAATACTCCATTT | 53 | 3287 |
| 1055172 | N/A | N/A | 212023 | 212042 | AGTCATTTCTCTCTGGCTGT | 53 | 3288 |
| 1055183 | N/A | N/A | 212039 | 212058 | AAATCAAGTCTATGTTAGTC | 63 | 3289 |

TABLE 44-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1055189 | N/A | N/A | 217280 | 217299 | TGTTTAAGGTATTTTCATGG | 8 | 3290 |
| 1055194 | N/A | N/A | 217286 | 217305 | CAGTTATGTTTAAGGTATTT | 19 | 3291 |
| 1055200 | N/A | N/A | 222603 | 222622 | CTGTTCTTAGCTTCCCAGCT | 39 | 3292 |
| 1055206 | N/A | N/A | 226993 | 227012 | TTATTTACTCATTCTACCTT | 82 | 3293 |
| 1055211 | N/A | N/A | 226999 | 227018 | ACTTGGTTATTTACTCATTC | 17 | 3294 |
| 1055217 | N/A | N/A | 230285 | 230304 | AATCTCCAGTTATGAGTAAG | 82 | 3295 |
| 1055223 | N/A | N/A | 251498 | 251517 | ATACTTAGCTTTTCAAATAC | 83 | 3296 |
| 1055228 | N/A | N/A | 251505 | 251524 | TGTCAGCATACTTAGCTTTT | 32 | 3297 |
| 1055234 | N/A | N/A | 251514 | 251533 | CCAGGACAGTGTCAGCATAC | 29 | 3298 |
| 1055240 | N/A | N/A | 284223 | 284242 | TTTTCTGTACAAAGTTCAGT | 4 | 3299 |
| 1055251 | N/A | N/A | 284239 | 284258 | TTAGTTTTGTTTGGGTTTTT | 2 | 3300 |
| 1055257 | N/A | N/A | 284338 | 284357 | CAACTAGTTCTTATCACTAT | 15 | 3301 |
| 1055262 | N/A | N/A | 284344 | 284363 | CAATGTCAACTAGTTCTTAT | 4 | 3302 |
| 1055268 | N/A | N/A | 291004 | 291023 | TTAGTTTTCCTTCTTGTCTT | 7 | 3303 |
| 1055274 | N/A | N/A | 291013 | 291032 | CCTGGGTTTTAGTTTTCCT | 3 | 3304 |
| 1055279 | N/A | N/A | 291020 | 291039 | ATTAGGTCCTGGGTTTTTAG | 3 | 3305 |
| 1055285 | N/A | N/A | 297001 | 297020 | GCATTAAATGACTGTGGTGC | 5 | 3306 |
| 1055290 | N/A | N/A | 297007 | 297026 | GTGTTTGCATTAAATGACTG | 4 | 3307 |
| 1055296 | N/A | N/A | 306730 | 306749 | ACTAAATCTGACCTTCCTCA | 35 | 3308 |
| 1055302 | N/A | N/A | 306741 306827 | 306760 306846 | TGGTAAGGGCCACTAAATCT | 4 | 3309 |
| 1055308 | N/A | N/A | 318481 | 318500 | TGATATTTCTTTTTTTTTA | 104 | 3310 |
| 1055313 | N/A | N/A | 318488 | 318507 | ATGTGTTTGATATTTCTTTT | 1 | 3311 |
| 1055319 | N/A | N/A | 324476 | 324495 | TGATCTAAATTGTGTCTTTT | 17 | 3312 |
| 1055325 | N/A | N/A | 332359 | 332378 | GTATTATAACAATTTGCATA | 6 | 3313 |
| 1055330 | N/A | N/A | 332365 | 332384 | CAGGGAGTATTATAACAATT | 2 | 3314 |
| 1055336 | N/A | N/A | 334250 | 334269 | TCATAGAAGCATTCTGTGTT | 90 | 3315 |
| 1055342 | N/A | N/A | 347821 | 347840 | GTCATTATCTAGTTTCTGGA | 2 | 3316 |
| 1055347 | N/A | N/A | 347827 | 347846 | CAAATGGTCATTATCTAGTT | 10 | 3317 |
| 1055353 | N/A | N/A | 355980 | 355999 | ATCTGCTAGGCATGCGGGAT | 27 | 3318 |
| 1055359 | N/A | N/A | 396488 | 396507 | TGATTTGTACACACCCAGCA | 62 | 3319 |
| 1055365 | N/A | N/A | 432459 | 432478 | GCACTGATCCAATAAAACCC | 93 | 3320 |

TABLE 45

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 2 | 138 |
| 994690 | N/A | N/A | 179789 | 179808 | GTTATATTTAATCATGTTCC | 4 | 538 |
| 994734 | N/A | N/A | 291014 | 291033 | TCCTGGGTTTTTAGTTTTCC | 2 | 232 |
| 1041358 | N/A | N/A | 438300 | 438319 | GAGAGTATAAAAATTATCTC | 93 | 3073 |
| 1054947 | 107 | 126 | 2617 | 2636 | CGGCTGCTGTTGCTCTGGCT | 25 | 3321 |
| 1054952 | 113 | 132 | 2623 | 2642 | GTCTTGCGGCTGCTGTTGCT | 16 | 3322 |
| 1054964 | 245 | 264 | 10656 | 10675 | GGTGACTTGATGCACGATGC | 7 | 3323 |
| 1054969 | 252 | 271 | 10663 | 10682 | CCACCCTGGTGACTTGATGC | 13 | 3324 |
| 1054975 | 558 | 577 | 178168 | 178187 | TAAGCTATCAGTTCCTTGCA | 5 | 3325 |
| 1054980 | 564 | 583 | 178174 | 178193 | GAACCATAAGCTATCAGTTC | 24 | 3326 |
| 1054986 | 580 | 599 | 178190 | 178209 | CTTTCATCACAATGGAGAAC | 101 | 3327 |
| 1054992 | 589 | 608 | 178199 | 178218 | TACCATGTGCTTTCATCACA | 6 | 3328 |
| 1054997 | 596 | 615 | N/A | N/A | AAAACTGTACCATGTGCTTT | 4 | 3329 |
| 1055002 | 5493 | 5512 | 459746 | 459765 | TTTGTTCAGTTTAGTTGCAG | 17 | 3330 |
| 1055006 | 5500 | 5519 | 459753 | 459772 | TCAGGTATTTGTTCAGTTTA | 6 | 3331 |
| 1055011 | 5509 | 5528 | 459762 | 459781 | AAAGAAAAGTCAGGTATTTG | 42 | 3332 |
| 1055017 | 6032 | 6051 | 460285 | 460304 | GTTGGTTTAGTGGATCCAGT | 42 | 3333 |
| 1055021 | 6038 | 6057 | 460291 | 460310 | CTTAGTGTTGGTTTAGTGGA | 28 | 3334 |
| 1055026 | 9480 | 9499 | 463733 | 463752 | AGATTGTTGTTATTGTATAG | 20 | 3335 |
| 1055031 | 9487 | 9506 | 463740 | 463759 | TTCTTAGAGATTGTTGTTAT | 20 | 3336 |
| 1055037 | 9496 | 9515 | 463749 | 463768 | TTATGGAAATTCTTAGAGAT | 67 | 3337 |
| 1055042 | 10094 | 10113 | 464347 | 464366 | GTAATGATCTGATATTAAAA | 54 | 3338 |
| 1055047 | 10100 | 10119 | 464353 | 464372 | TGGTGGGTAATGATCTGATA | 14 | 3339 |
| 1055053 | 192 | 211 | N/A | N/A | GTTTTTGTGAGGTAAAACTG | 111 | 3340 |
| 1055058 | 199 | 218 | 9915 | 9934 | TGTAGTAGTTTTTGTGAGGT | 19 | 3341 |
| 1055061 | 208 | 227 | 9924 | 9943 | CTTGGTGCTTGTAGTAGTTT | 25 | 3342 |
| 1055067 | N/A | N/A | 17724 | 17743 | CACCTTTTCTATTTGCACTA | 23 | 3343 |
| 1055073 | N/A | N/A | 17732 | 17751 | TCAAATGTCACCTTTTCTAT | 52 | 3344 |
| 1055079 | N/A | N/A | 49576 | 49595 | ATAGCAAGTCCCCTGAAGCT | 83 | 3345 |
| 1055085 | N/A | N/A | 85513 | 85532 | TGATATGCTATGCTCACAGA | 25 | 3346 |
| 1055090 | N/A | N/A | 85519 | 85538 | TTAGTTTGATATGCTATGCT | 36 | 3347 |
| 1055095 | N/A | N/A | 99353 | 99372 | CACAGAACACTTTTTCCAGA | 41 | 3348 |
| 1055101 | N/A | N/A | 144499 | 144518 | ATCACACAGCAGCATGTTTA | 72 | 3349 |
| 1055107 | N/A | N/A | 179781 | 179800 | TAATCATGTTCCCGATATTG | 21 | 3350 |
| 1055117 | N/A | N/A | 179797 | 179816 | CTAACATAGTTATATTTAAT | 121 | 3351 |
| 1055123 | N/A | N/A | 184181 | 184200 | GGTTTATATGTATACAATTC | 3 | 3352 |

TABLE 45-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1055128 | N/A | N/A | 184187 | 184206 | TTCTCAGGTTTATATGTATA | 5 | 3353 |
| 1055134 | N/A | N/A | 203027 | 203046 | TTCTTTGTTCATAGGAGAAC | 91 | 3354 |
| 1055140 | N/A | N/A | 203036 | 203055 | GTTCCTTTCTTCTTTGTTCA | 17 | 3355 |
| 1055145 | N/A | N/A | 203043 | 203062 | ACCTCTTGTTCCTTTCTTCT | 10 | 3356 |
| 1055151 | N/A | N/A | 203889 | 203908 | GTTTAGATTTATCCTCAGGA | 3 | 3357 |
| 1055156 | N/A | N/A | 203895 | 203914 | GGGTTTGTTTAGATTTATCC | 19 | 3358 |
| 1055162 | N/A | N/A | 210728 | 210747 | TGTAATACTCCATTTTTCCT | 15 | 3359 |
| 1055167 | N/A | N/A | 210734 | 210753 | CAAATGTGTAATACTCCATT | 16 | 3360 |
| 1055173 | N/A | N/A | 212025 | 212044 | TTAGTCATTTCTCTCTGGCT | 50 | 3361 |
| 1055178 | N/A | N/A | 212032 | 212051 | GTCTATGTTAGTCATTTCTC | 13 | 3362 |
| 1055184 | N/A | N/A | 212041 | 212060 | AAAAATCAAGTCTATGTTAG | 118 | 3363 |
| 1055190 | N/A | N/A | 217281 | 217300 | ATGTTTAAGGTATTTTCATG | 41 | 3364 |
| 1055195 | N/A | N/A | 217287 | 217306 | ACAGTTATGTTTAAGGTATT | 39 | 3365 |
| 1055201 | N/A | N/A | 226199 | 226218 | AAAACAGACTTCGATTTGGA | 70 | 3366 |
| 1055207 | N/A | N/A | 226994 | 227013 | GTTATTTACTCATTCTACCT | 42 | 3367 |
| 1055212 | N/A | N/A | 227000 | 227019 | AACTTGGTTATTTACTCATT | 25 | 3368 |
| 1055218 | N/A | N/A | 233991 | 234010 | AAGTTGGAGAAGTCACCAGC | 103 | 3369 |
| 1055224 | N/A | N/A | 251500 | 251519 | GCATACTTAGCTTTTCAAAT | 6 | 3370 |
| 1055229 | N/A | N/A | 251506 | 251525 | GTGTCAGCATACTTAGCTTT | 27 | 3371 |
| 1055235 | N/A | N/A | 254560 | 254579 | TCTTGGAGGTGACATTTGTG | 55 | 3372 |
| 1055241 | N/A | N/A | 284225 | 284244 | GTTTTTCTGTACAAAGTTCA | 2 | 3373 |
| 1055246 | N/A | N/A | 284232 | 284251 | TGTTTGGGTTTTTCTGTACA | 1 | 3374 |
| 1055252 | N/A | N/A | 284241 | 284260 | CTTTAGTTTTGTTTGGGTTT | 2 | 3375 |
| 1055258 | N/A | N/A | 284339 | 284358 | TCAACTAGTTCTTATCACTA | 4 | 3376 |
| 1055263 | N/A | N/A | 284345 | 284364 | ACAATGTCAACTAGTTCTTA | 2 | 3377 |
| 1055269 | N/A | N/A | 291006 | 291025 | TTTTAGTTTTCCTTCTTGTC | 5 | 3378 |
| 1055280 | N/A | N/A | 291022 | 291041 | AGATTAGGTCCTGGGTTTTT | 2 | 3379 |
| 1055286 | N/A | N/A | 297002 | 297021 | TGCATTAAATGACTGTGGTG | 4 | 3380 |
| 1055291 | N/A | N/A | 297008 | 297027 | AGTGTTTGCATTAAATGACT | 5 | 3381 |
| 1055297 | N/A | N/A | 306732 | 306751 | CCACTAAATCTGACCTTCCT | 37 | 3382 |
| 1055303 | N/A | N/A | 306746 | 306765 | TCCATTGGTAAGGGCCACTA | 2 | 3383 |
| 1055309 | N/A | N/A | 318483 | 318502 | TTTGATATTTCTTTTTTTTT | 96 | 3384 |
| 1055314 | N/A | N/A | 318489 | 318508 | AATGTGTTTGATATTTCTTT | 1 | 3385 |
| 1055320 | N/A | N/A | 326832 | 326851 | CAGTTTTGAGATGGTTTGAA | 3 | 3386 |
| 1055326 | N/A | N/A | 332360 | 332379 | AGTATTATAACAATTTGCAT | 22 | 3387 |
| 1055331 | N/A | N/A | 332366 | 332385 | CCAGGGAGTATTATAACAAT | 2 | 3388 |

TABLE 45-continued

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1055337 | N/A | N/A | 347813 | 347832 | CTAGTTTCTGGAAAGTAATG | 36 | 3389 |
| 1055343 | N/A | N/A | 347822 | 347841 | GGTCATTATCTAGTTTCTGG | 1 | 3390 |
| 1055348 | N/A | N/A | 347829 | 347848 | AACAAATGGTCATTATCTAG | 9 | 3391 |
| 1055354 | N/A | N/A | 358326 | 358345 | CCAAATTCCTGGTTGCTGTG | 4 | 3392 |
| 1055360 | N/A | N/A | 397561 | 397580 | AGGGCCTCTTGGATTTTGTT | 130 | 3393 |

TABLE 46

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994314 | 246 | 265 | 10657 | 10676 | TGGTGACTTGATGCACGATG | 12 | 491 |
| 994329 | 590 | 609 | 178200 | 178219 | GTACCATGTGCTTTCATCAC | 5 | 415 |
| 994465 | 6033 | 6052 | 460286 | 460305 | TGTTGGTTTAGTGGATCCAG | 21 | 432 |
| 994467 | 6040 | 6059 | 460293 | 460312 | ATCTTAGTGTTGGTTTAGTG | 20 | 588 |
| 994605 | N/A | N/A | 17726 | 17745 | GTCACCTTTTCTATTTGCAC | 4 | 138 |
| 994700 | N/A | N/A | 203037 | 203056 | TGTTCCTTTCTTCTTTGTTC | 10 | 72 |
| 994761 | N/A | N/A | 347823 | 347842 | TGGTCATTATCTAGTTTCTG | 2 | 469 |
| 1054948 | 108 | 127 | 2618 | 2637 | GCGGCTGCTGTTGCTCTGGC | 57 | 3394 |
| 1054953 | 114 | 133 | 2624 | 2643 | TGTCTTGCGGCTGCTGTTGC | 16 | 3395 |
| 1054970 | 254 | 273 | 10665 | 10684 | GACCACCCTGGTGACTTGAT | 9 | 3396 |
| 1054976 | 559 | 578 | 178169 | 178188 | ATAAGCTATCAGTTCCTTGC | 11 | 3397 |
| 1054981 | 565 | 584 | 178175 | 178194 | AGAACCATAAGCTATCAGTT | 7 | 3398 |
| 1054987 | 582 | 601 | 178192 | 178211 | TGCTTTCATCACAATGGAGA | 62 | 3399 |
| 1054998 | 598 | 617 | N/A | N/A | GGAAAACTGTACCATGTGCT | 4 | 3400 |
| 1055003 | 5495 | 5514 | 459748 | 459767 | TATTTGTTCAGTTTAGTTGC | 9 | 3401 |
| 1055007 | 5501 | 5520 | 459754 | 459773 | GTCAGGTATTTGTTCAGTTT | 9 | 3402 |
| 1055012 | 6024 | 6043 | 460277 | 460296 | AGTGGATCCAGTCAATTCAA | 34 | 3403 |
| 1055027 | 9482 | 9501 | 463735 | 463754 | AGAGATTGTTGTTATTGTAT | 16 | 3404 |
| 1055032 | 9488 | 9507 | 463741 | 463760 | ATTCTTAGAGATTGTTGTTA | 21 | 3405 |
| 1055038 | 10086 | 10105 | 464339 | 464358 | CTGATATTAAAACATCCAGT | 21 | 3406 |
| 1055043 | 10095 | 10114 | 464348 | 464367 | GGTAATGATCTGATATTAAA | 15 | 3407 |
| 1055048 | 10102 | 10121 | 464355 | 464374 | TATGGTGGGTAATGATCTGA | 16 | 3408 |
| 1055054 | 194 | 213 | 9910 | 9929 | TAGTTTTTGTGAGGTAAAAC | 83 | 3409 |
| 1055059 | 200 | 219 | 9916 | 9935 | TTGTAGTAGTTTTTGTGAGG | 28 | 3410 |
| 1055062 | N/A | N/A | 17716 | 17735 | CTATTTGCACTAGCTGCCTA | 75 | 3411 |

TABLE 46-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1055068 | N/A | N/A | 17725 | 17744 | TCACCTTTTCTATTTGCACT | 10 | 3412 |
| 1055074 | N/A | N/A | 17734 | 17753 | TCTCAAATGTCACCTTTTCT | 44 | 3413 |
| 1055080 | N/A | N/A | 54036 | 54055 | AACCATATGACATCTCAACA | 33 | 3414 |
| 1055086 | N/A | N/A | 85514 | 85533 | TTGATATGCTATGCTCACAG | 18 | 3415 |
| 1055091 | N/A | N/A | 85520 | 85539 | GTTAGTTTGATATGCTATGC | 36 | 3416 |
| 1055096 | N/A | N/A | 103883 | 103902 | CAACTGAAAATTCTACACAC | 110 | 3417 |
| 1055102 | N/A | N/A | 147181 | 147200 | CAGTAGTCTCCCCATAGCCA | 76 | 3418 |
| 1055108 | N/A | N/A | 179783 | 179802 | TTTAATCATGTTCCCGATAT | 57 | 3419 |
| 1055113 | N/A | N/A | 179790 | 179809 | AGTTATATTTAATCATGTTC | 17 | 3420 |
| 1055118 | N/A | N/A | 179799 | 179818 | CACTAACATAGTTATATTTA | 72 | 3421 |
| 1055124 | N/A | N/A | 184182 | 184201 | AGGTTTATATGTATACAATT | 13 | 3422 |
| 1055129 | N/A | N/A | 184188 | 184207 | GTTCTCAGGTTTATATGTAT | 5 | 3423 |
| 1055135 | N/A | N/A | 203029 | 203048 | TCTTCTTTGTTCATAGGAGA | 147 | 3424 |
| 1055146 | N/A | N/A | 203045 | 203064 | CAACCTCTTGTTCCTTTCTT | 52 | 3425 |
| 1055152 | N/A | N/A | 203890 | 203909 | TGTTTAGATTTATCCTCAGG | 5 | 3426 |
| 1055157 | N/A | N/A | 210720 | 210739 | TCCATTTTTCCTTCTAGATT | 19 | 3427 |
| 1055163 | N/A | N/A | 210729 | 210748 | GTGTAATACTCCATTTTTCC | 5 | 3428 |
| 1055168 | N/A | N/A | 210736 | 210755 | TACAAATGTGTAATACTCCA | 6 | 3429 |
| 1055174 | N/A | N/A | 212027 | 212046 | TGTTAGTCATTTCTCTCTGG | 23 | 3430 |
| 1055179 | N/A | N/A | 212033 | 212052 | AGTCTATGTTAGTCATTTCT | 24 | 3431 |
| 1055185 | N/A | N/A | 213048 | 213067 | GATGATAAATTAAGGCAGAG | 22 | 3432 |
| 1055191 | N/A | N/A | 217282 | 217301 | TATGTTTAAGGTATTTTCAT | 47 | 3433 |
| 1055196 | N/A | N/A | 217288 | 217307 | AACAGTTATGTTTAAGGTAT | 43 | 3434 |
| 1055202 | N/A | N/A | 226986 | 227005 | CTCATTCTACCTTCAACTCT | 94 | 3435 |
| 1055208 | N/A | N/A | 226995 | 227014 | GGTTATTTACTCATTCTACC | 14 | 3436 |
| 1055213 | N/A | N/A | 227002 | 227021 | TAAACTTGGTTATTTACTCA | 79 | 3437 |
| 1055219 | N/A | N/A | 236034 | 236053 | GAGTGAGCATTAGATGGTCA | 56 | 3438 |
| 1055225 | N/A | N/A | 251501 | 251520 | AGCATACTTAGCTTTTCAAA | 10 | 3439 |
| 1055230 | N/A | N/A | 251507 | 251526 | AGTGTCAGCATACTTAGCTT | 16 | 3440 |
| 1055236 | N/A | N/A | 257663 | 257682 | AGGGAAATGGTCATTTTCTA | 87 | 3441 |
| 1055242 | N/A | N/A | 284227 | 284246 | GGGTTTTTCTGTACAAAGTT | 4 | 3442 |
| 1055247 | N/A | N/A | 284233 | 284252 | TTGTTTGGGTTTTTCTGTAC | 3 | 3443 |
| 1055253 | N/A | N/A | 284331 | 284350 | TTCTTATCACTATTCAGTCA | 3 | 3444 |
| 1055259 | N/A | N/A | 284340 | 284359 | GTCAACTAGTTCTTATCACT | 2 | 3445 |
| 1055264 | N/A | N/A | 284347 | 284366 | AAACAATGTCAACTAGTTCT | 12 | 3446 |
| 1055270 | N/A | N/A | 291008 | 291027 | GTTTTTAGTTTTCCTTCTTG | 3 | 3447 |

TABLE 46-continued

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1055275 | N/A | N/A | 291015 | 291034 | GTCCTGGGTTTTTAGTTTTC | 2 | 3448 |
| 1055281 | N/A | N/A | 291024 | 291043 | GAAGATTAGGTCCTGGGTTT | 5 | 3449 |
| 1055287 | N/A | N/A | 297003 | 297022 | TTGCATTAAATGACTGTGGT | 2 | 3450 |
| 1055292 | N/A | N/A | 297009 | 297028 | CAGTGTTTGCATTAAATGAC | 3 | 3451 |
| 1055298 | N/A | N/A | 306734 | 306753 | GGCCACTAAATCTGACCTTC | 54 | 3452 |
| 1055304 | N/A | N/A | 306748 | 306767 | AATCCATTGGTAAGGGCCAC | 4 | 3453 |
| 1055310 | N/A | N/A | 318484 | 318503 | GTTTGATATTTCTTTTTTTT | 2 | 3454 |
| 1055315 | N/A | N/A | 318491 | 318510 | CAAATGTGTTTGATATTTCT | 3 | 3455 |
| 1055321 | N/A | N/A | 332352 | 332371 | AACAATTTGCATAGTCTCTC | 3 | 3456 |
| 1055327 | N/A | N/A | 332361 | 332380 | GAGTATTATAACAATTTGCA | 3 | 3457 |
| 1055332 | N/A | N/A | 332368 | 332387 | TTCCAGGGAGTATTATAACA | 2 | 3458 |
| 1055338 | N/A | N/A | 347815 | 347834 | ATCTAGTTTCTGGAAAGTAA | 22 | 3459 |
| 1055349 | N/A | N/A | 347831 | 347850 | ATAACAAATGGTCATTATCT | 43 | 3460 |
| 1055355 | N/A | N/A | 365965 | 365984 | AATCCAAATCTTGTATTCTT | 9 | 3461 |
| 1055361 | N/A | N/A | 399995 | 400014 | TCTAGAAATGATTTTGATTA | 107 | 3462 |
| 1055366 | N/A | N/A | 439847 | 439866 | TGGGCATTTAAGAAATGCTC | 140 | 3463 |

TABLE 47

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994448 | 5496 | 5515 | 459749 | 459768 | GTATTTGTTCAGTTTAGTTG | 9 | 352 |
| 994466 | 6034 | 6053 | 460287 | 460306 | GTGTTGGTTTAGTGGATCCA | 21 | 510 |
| 994571 | 10096 | 10115 | 464349 | 464368 | GGGTAATGATCTGATATTAA | 10 | 601 |
| 994598 | 201 | 220 | 9917 | 9936 | CTTGTAGTAGTTTTTGTGAG | 42 | 215 |
| 994605 | N/A | N/A | 17726 | 17745 | GTCACCTTTTCTATTTGCAC | 3 | 138 |
| 994702 | N/A | N/A | 210730 | 210749 | TGTGTAATACTCCATTTTTC | 8 | 228 |
| 994713 | N/A | N/A | 226996 | 227015 | TGGTTATTTACTCATTCTAC | 10 | 463 |
| 994732 | N/A | N/A | 284341 | 284360 | TGTCAACTAGTTCTTATCAC | 3 | 76 |
| 994743 | N/A | N/A | 318485 | 318504 | TGTTTGATATTTCTTTTTTT | 3 | 311 |
| 994756 | N/A | N/A | 332362 | 332381 | GGAGTATTATAACAATTTGC | 1 | 79 |
| 1040299 | 5502 | 5521 | 459755 | 459774 | AGTCAGGTATTTGTTCAGTT | 6 | 2809 |
| 1040631 | 10088 | 10107 | 464341 | 464360 | ATCTGATATTAAAACATCCA | 18 | 1280 |
| 1054949 | 109 | 128 | 2619 | 2638 | TGCGGCTGCTGTTGCTCTGG | 22 | 3464 |

TABLE 47-continued

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1054954 | 115 | 134 | 2625 | 2644 | ATGTCTTGCGGCTGCTGTTG | 10 | 3465 |
| 1054965 | 247 | 266 | 10658 | 10677 | CTGGTGACTTGATGCACGAT | 21 | 3466 |
| 1054971 | 256 | 275 | 10667 | 10686 | TGGACCACCCTGGTGACTTG | 17 | 3467 |
| 1054977 | 560 | 579 | 178170 | 178189 | CATAAGCTATCAGTTCCTTG | 5 | 3468 |
| 1054982 | 566 | 585 | 178176 | 178195 | GAGAACCATAAGCTATCAGT | 11 | 3469 |
| 1054988 | 584 | 603 | 178194 | 178213 | TGTGCTTTCATCACAATGGA | 56 | 3470 |
| 1054993 | 591 | 610 | 178201 | 178220 | TGTACCATGTGCTTTCATCA | 3 | 3471 |
| 1054999 | 600 | 619 | N/A | N/A | TTGGAAAACTGTACCATGTG | 8 | 3472 |
| 1055013 | 6026 | 6045 | 460279 | 460298 | TTAGTGGATCCAGTCAATTC | 31 | 3473 |
| 1055022 | 6042 | 6061 | 460295 | 460314 | CCATCTTAGTGTTGGTTTAG | 23 | 3474 |
| 1055028 | 9483 | 9502 | 463736 | 463755 | TAGAGATTGTTGTTATTGTA | 14 | 3475 |
| 1055033 | 9489 | 9508 | 463742 | 463761 | AATTCTTAGAGATTGTTGTT | 19 | 3476 |
| 1055049 | 10104 | 10123 | 464357 | 464376 | CATATGGTGGGTAATGATCT | 62 | 3477 |
| 1055055 | 195 | 214 | 9911 | 9930 | GTAGTTTTTGTGAGGTAAAA | 8 | 3478 |
| 1055063 | N/A | N/A | 17718 | 17737 | TTCTATTTGCACTAGCTGCC | 78 | 3479 |
| 1055069 | N/A | N/A | 17727 | 17746 | TGTCACCTTTTCTATTTGCA | 2 | 3480 |
| 1055075 | N/A | N/A | 17736 | 17755 | CCTCTCAAATGTCACCTTTT | 85 | 3481 |
| 1055081 | N/A | N/A | 85506 | 85525 | CTATGCTCACAGAGAACCTG | 98 | 3482 |
| 1055087 | N/A | N/A | 85515 | 85534 | TTTGATATGCTATGCTCACA | 13 | 3483 |
| 1055092 | N/A | N/A | 85522 | 85541 | CAGTTAGTTTGATATGCTAT | 25 | 3484 |
| 1055097 | N/A | N/A | 103952 | 103971 | TGTGATTTATCGCTGACCTT | 53 | 3485 |
| 1055103 | N/A | N/A | 148568 | 148587 | GAATGGTTCTCTTTTACGGG | 8 | 3486 |
| 1055109 | N/A | N/A | 179785 | 179804 | TATTTAATCATGTTCCCGAT | 19 | 3487 |
| 1055114 | N/A | N/A | 179791 | 179810 | TAGTTATATTTAATCATGTT | 63 | 3488 |
| 1055119 | N/A | N/A | 184174 | 184193 | ATGTATACAATTCTGACAGT | 49 | 3489 |
| 1055125 | N/A | N/A | 184183 | 184202 | CAGGTTTATATGTATACAAT | 5 | 3490 |
| 1055130 | N/A | N/A | 184190 | 184209 | ATGTTCTCAGGTTTATATGT | 5 | 3491 |
| 1055136 | N/A | N/A | 203031 | 203050 | TTTCTTCTTTGTTCATAGGA | 71 | 3492 |
| 1055141 | N/A | N/A | 203038 | 203057 | TTGTTCCTTTCTTCTTTGTT | 46 | 3493 |
| 1055147 | N/A | N/A | 203047 | 203066 | AACAACCTCTTGTTCCTTTC | 13 | 3494 |
| 1055153 | N/A | N/A | 203891 | 203910 | TTGTTTAGATTTATCCTCAG | 6 | 3495 |
| 1055158 | N/A | N/A | 210722 | 210741 | ACTCCATTTTCCTTCTAGA | 6 | 3496 |
| 1055169 | N/A | N/A | 210738 | 210757 | ATTACAAATGTGTAATACTC | 62 | 3497 |
| 1055175 | N/A | N/A | 212028 | 212047 | ATGTTAGTCATTTCTCTCTG | 20 | 3498 |
| 1055180 | N/A | N/A | 212034 | 212053 | AAGTCTATGTTAGTCATTTC | 31 | 3499 |
| 1055186 | N/A | N/A | 217274 | 217293 | AGGTATTTTCATGGAGTTTC | 3 | 3500 |

TABLE 47-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1055192 | N/A | N/A | 217283 | 217302 | TTATGTTTAAGGTATTTTCA | 60 | 3501 |
| 1055197 | N/A | N/A | 217290 | 217309 | GTAACAGTTATGTTTAAGGT | 8 | 3502 |
| 1055203 | N/A | N/A | 226988 | 227007 | TACTCATTCTACCTTCAACT | 72 | 3503 |
| 1055214 | N/A | N/A | 227004 | 227023 | CATAAACTTGGTTATTTACT | 65 | 3504 |
| 1055220 | N/A | N/A | 248565 | 248584 | CCACTACCACCCCCAAACCA | 53 | 3505 |
| 1055226 | N/A | N/A | 251502 | 251521 | CAGCATACTTAGCTTTTCAA | 16 | 3506 |
| 1055231 | N/A | N/A | 251508 | 251527 | CAGTGTCAGCATACTTAGCT | 20 | 3507 |
| 1055237 | N/A | N/A | 259737 | 259756 | CATGTATTGCTAGGAGCCAG | 46 | 3508 |
| 1055243 | N/A | N/A | 284228 | 284247 | TGGGTTTTTCTGTACAAAGT | 2 | 3509 |
| 1055248 | N/A | N/A | 284234 | 284253 | TTTGTTTGGGTTTTTCTGTA | 2 | 3510 |
| 1055254 | N/A | N/A | 284333 | 284352 | AGTTCTTATCACTATTCAGT | 2 | 3511 |
| 1055265 | N/A | N/A | 284349 | 284368 | CTAAACAATGTCAACTAGTT | 61 | 3512 |
| 1055271 | N/A | N/A | 291010 | 291029 | GGGTTTTAGTTTTCCTTCT | 2 | 3513 |
| 1055276 | N/A | N/A | 291016 | 291035 | GGTCCTGGGTTTTAGTTTT | 3 | 3514 |
| 1055282 | N/A | N/A | 296995 | 297014 | AATGACTGTGGTGCAGCCTC | 27 | 3515 |
| 1055288 | N/A | N/A | 297004 | 297023 | TTTGCATTAAATGACTGTGG | 2 | 3516 |
| 1055293 | N/A | N/A | 297011 | 297030 | GCCAGTGTTTGCATTAAATG | 2 | 3517 |
| 1055299 | N/A | N/A | 306736 | 306755 | AGGGCCACTAAATCTGACCT | 118 | 3518 |
| 1055305 | N/A | N/A | 306750 | 306769 | AGAATCCATTGGTAAGGGCC | 6 | 3519 |
| 1055316 | N/A | N/A | 318493 | 318512 | TTCAAATGTGTTTGATATTT | 12 | 3520 |
| 1055322 | N/A | N/A | 332354 | 332373 | ATAACAATTTGCATAGTCTC | 4 | 3521 |
| 1055333 | N/A | N/A | 332370 | 332389 | TTTTCCAGGGAGTATTATAA | 21 | 3522 |
| 1055339 | N/A | N/A | 347817 | 347836 | TTATCTAGTTTCTGGAAAGT | 39 | 3523 |
| 1055344 | N/A | N/A | 347824 | 347843 | ATGGTCATTATCTAGTTTCT | 2 | 3524 |
| 1055350 | N/A | N/A | 347833 | 347852 | TGATAACAAATGGTCATTAT | 32 | 3525 |
| 1055356 | N/A | N/A | 372672 | 372691 | CATCAAAATTGTGCACAATT | 81 | 3526 |
| 1055362 | N/A | N/A | 402059 | 402078 | TGAAAACATGTTGTGTGATT | 57 | 3527 |
| 1055367 | N/A | N/A | 453507 | 453526 | TTGTTGGATTCTTTTTTTCT | 27 | 3528 |

TABLE 48

Reduction of ATXN1 RNA by 5-10-5 MOE gapmers with mixed PO/PS linkages in A-431 Cells

| Compound Number | SEQ ID NO: 3 Start Site | SEQ ID NO: 3 Stop Site | Sequence (5' to 3') | ATXN1 (% Control) | SEQ ID NO |
|---|---|---|---|---|---|
| 1054961 | 193 | 212 | GACTTGATGCACGATGCTCT | 8 | 3529 |
| 1054958 | 187 | 206 | ATGCACGATGCTCTGTAAAG | 51 | 3530 |
| 1054959 | 189 | 208 | TGATGCACGATGCTCTGTAA | 42 | 3531 |
| 1054960 | 191 | 210 | CTTGATGCACGATGCTCTGT | 48 | 3532 |

Example 3: Effect of Modified Oligonucleotides on Human ATXN1 RNA In Vitro, Multiple Doses Modified oligonucleotides selected from the examples above were tested at various doses in A-431 cells. Cultured A-431 cells at a density of 10,000 cells per well were treated using free uptake with various concentrations of modified oligonucleotide as specified in the tables below. After a treatment period of approximately 48 hours, total RNA was isolated from the cells and ATXN1 RNA levels were measured by quantitative real-time RTPCR. Human ATXN1 primer probe set RTS37573 was used to measure RNA levels as described above. ATXN1 levels were adjusted according to total RNA content, as measured by RIBOGREEN®. Results are presented in the tables below as percent reduction of the amount of ATXN1 RNA, relative to untreated control. Where possible, the half maximal inhibitory concentration ($IC_{50}$) of each modified oligonucleotide was calculated using a linear regression on a log/linear plot of the data in excel.

TABLE 49

Dose-dependent percent reduction of human ATXN1 RNA in A-431 cells by modified oligonucleotides

| Compound No. | % Control | | | | IC50 (µM) |
|---|---|---|---|---|---|
| | 125 nM | 500 nM | 2000 nM | 8000 nM | |
| 994310 | 60 | 32 | 19 | 12 | 0.2 |
| 994316 | 36 | 15 | 9 | 9 | <0.1 |
| 994318 | 46 | 12 | 9 | 7 | <0.1 |
| 994319 | 31 | 13 | 8 | 7 | <0.1 |
| 994392 | 50 | 26 | 13 | 10 | <0.1 |
| 994421 | 16 | 8 | 8 | 10 | <0.1 |
| 994492 | 48 | 25 | 15 | 15 | <0.1 |
| 994542 | 55 | 36 | 25 | 22 | 0.1 |
| 994612 | 22 | 11 | 9 | 9 | <0.1 |
| 994613 | 30 | 23 | 15 | 14 | <0.1 |
| 994623 | 59 | 50 | 40 | 35 | 0.5 |
| 994628 | 21 | 9 | 7 | 9 | <0.1 |
| 994631 | 42 | 25 | 12 | 10 | <0.1 |
| 994645 | 90 | 78 | 68 | 56 | >8.0 |
| 994646 | 64 | 39 | 28 | 21 | 0.3 |
| 994652 | 24 | 11 | 9 | 9 | <0.1 |
| 994653 | 35 | 21 | 13 | 11 | <0.1 |
| 994812 | 31 | 13 | 9 | 8 | <0.1 |

TABLE 50

Dose-dependent percent reduction of human ATXN1 RNA in A-431 cells by modified oligonucleotides

| Compound No. | % Control | | | | IC50 (µM) |
|---|---|---|---|---|---|
| | 125 nM | 500 nM | 2000 nM | 8000 nM | |
| 994315 | 7 | 6 | 6 | 7 | <0.1 |
| 994320 | 11 | 7 | 4 | 5 | <0.1 |
| 994321 | 42 | 25 | 13 | 6 | <0.1 |
| 994395 | 41 | 27 | 21 | 12 | <0.1 |
| 994609 | 18 | 9 | 8 | 7 | <0.1 |
| 994610 | 94 | 95 | 79 | 63 | >8.0 |
| 994612 | 23 | 11 | 9 | 10 | <0.1 |
| 994616 | 70 | 51 | 40 | 27 | 0.7 |
| 994618 | 60 | 25 | 16 | 14 | 0.1 |
| 994619 | 53 | 32 | 18 | 10 | <0.1 |
| 994642 | 52 | 26 | 16 | 11 | <0.1 |
| 994643 | 56 | 35 | 23 | 17 | 0.2 |
| 994649 | 39 | 23 | 19 | 18 | <0.1 |
| 994651 | 21 | 9 | 7 | 6 | <0.1 |
| 994656 | 62 | 35 | 20 | 14 | 0.2 |
| 994696 | 34 | 17 | 12 | 9 | <0.1 |
| 994698 | 82 | 58 | 51 | 36 | 1.9 |
| 994770 | 46 | 23 | 12 | 11 | <0.1 |
| 994913 | 48 | 30 | 18 | 12 | <0.1 |

TABLE 51

Dose-dependent percent reduction of human ATXN1 RNA by modified oligonucleotides

| Compound No. | % Control | | | | IC50 (µM) |
|---|---|---|---|---|---|
| | 125 nM | 500 nM | 2000 nM | 8000 nM | |
| 994328 | 115 | 120 | 134 | 116 | >8.0 |
| 994597 | 57 | 24 | 11 | 10 | <0.1 |
| 994599 | 55 | 36 | 30 | 22 | 0.1 |
| 994612 | 28 | 12 | 8 | 12 | <0.1 |
| 994630 | 68 | 43 | 26 | 15 | 0.4 |
| 994638 | 76 | 40 | 22 | 15 | 0.4 |
| 994693 | 78 | 55 | 35 | 17 | 0.8 |
| 994700 | 12 | 5 | 4 | 4 | <0.1 |
| 994701 | 63 | 36 | 19 | 16 | 0.2 |
| 994702 | 50 | 27 | 16 | 12 | <0.1 |
| 994703 | 66 | 43 | 29 | 16 | 0.4 |
| 994717 | 11 | 8 | 9 | 6 | <0.1 |
| 994732 | 21 | 11 | 9 | 9 | <0.1 |
| 994734 | 9 | 4 | 2 | 2 | <0.1 |
| 994735 | 49 | 21 | 15 | 14 | <0.1 |
| 994740 | 67 | 37 | 20 | 15 | 0.3 |
| 994743 | 23 | 11 | 9 | 11 | <0.1 |
| 994756 | 39 | 21 | 13 | 12 | <0.1 |
| 994918 | 63 | 41 | 24 | 15 | 0.3 |

TABLE 52

Dose-dependent percent reduction of human ATXN1 RNA by modified oligonucleotides

| Compound No. | % Control | | | | IC50 (µM) |
|---|---|---|---|---|---|
| | 125 nM | 500 nM | 2000 nM | 8000 nM | |
| 994313 | 63 | 31 | 15 | 9 | 0.2 |
| 994314 | 41 | 19 | 10 | 15 | <0.1 |
| 994329 | 18 | 7 | 5 | 5 | <0.1 |
| 994346 | 17 | 8 | 6 | 8 | <0.1 |
| 994449 | 28 | 9 | 8 | 10 | <0.1 |
| 994466 | 103 | 104 | 79 | 79 | >8.0 |
| 994474 | 36 | 14 | 13 | 11 | <0.1 |

TABLE 52-continued

Dose-dependent percent reduction of human ATXN1 RNA by modified oligonucleotides

| Compound No. | % Control | | | | IC50 (μM) |
|---|---|---|---|---|---|
| | 125 nM | 500 nM | 2000 nM | 8000 nM | |
| 994497 | 16 | 9 | 9 | 10 | <0.1 |
| 994561 | 34 | 17 | 12 | 10 | <0.1 |
| 994571 | 95 | 77 | 76 | 73 | >8.0 |
| 994612 | 26 | 12 | 10 | 9 | <0.1 |
| 994690 | 87 | 60 | 42 | 40 | 1.9 |
| 994697 | 23 | 10 | 6 | 5 | <0.1 |
| 994706 | 12 | 7 | 5 | 5 | <0.1 |
| 994713 | 79 | 61 | 24 | 11 | 0.7 |
| 994731 | 65 | 31 | 18 | 16 | 0.2 |
| 994761 | 57 | 25 | 14 | 14 | <0.1 |
| 994835 | 75 | 36 | 21 | 19 | 0.4 |
| 994848 | 61 | 33 | 22 | 16 | 0.2 |

Example 4: Design of Modified Oligonucleotides Complementary to a Human ATXN1 Nucleic Acid Modified oligonucleotides were designed and synthesized as indicated in the tables below.

The compounds in table 53 are 5-10-5 MOE gapmers with mixed internucleoside linkages. The gapmers are 20 nucleosides in length, wherein the central gap segment consists of ten 2'-β-D-deoxynucleosides, the 5' wing segment consists of five 2'-MOE nucleosides, and the 3' wing segment consists of five 2'-MOE nucleosides. The sugar motif of the gapmers is (from 5' to 3'): eeeeedddddddddeeeee; wherein 'd' represents a 2'-β-D-deoxyribosyl sugar moiety, and 'e' represents a 2'-MOE sugar moiety. The gapmers have an internucleoside linkage motif of (from 5' to 3'): sooosssssssssssooss; wherein "s" represents a phosphorothioate internucleoside linkage and "o" represents a phosphodiester internucleoside linkage. All cytosine residues are 5-methylcytosines.

TABLE 53

5-10-5 MOE gapmers with mixed PO/PS internucleoside linkages complementary to human ATXN1

| Compound Number | SEQUENCE | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1342029 | TGATTGTGTTCCATTGTAAA | 7023 | 7042 | 461276 | 461295 | 3533 |
| 1342030 | GAGTTGTCCATAGTCATGAA | 4432 | 4451 | 458685 | 458704 | 3534 |
| 1342031 | CGAGTTGTCCATAGTCATGA | 4433 | 4452 | 458686 | 458705 | 3535 |
| 1342033 | TGCACTTTTGTTTCTACAGC | N/A | N/A | 441087 | 441106 | 3536 |
| 1342034 | AGGCCTTGCACTTTTGTTTC | N/A | N/A | 441093 | 441112 | 3537 |
| 1342035 | AAGTGGCACCCGAGTTGTCC | 4443 | 4462 | 458696 | 458715 | 3538 |
| 1342036 | GCCTTGCACTTTTGTTTCTA | N/A | N/A | 441091 | 441110 | 3539 |
| 1342037 | GATTGTGTTCCATTGTAAAC | 7022 | 7041 | 461275 | 461294 | 3540 |
| 1342039 | GTGGATCCAGTCAATTCAAT | 6023 | 6042 | 460276 | 460295 | 3541 |
| 1342040 | AATAGCAGCTATTTCATGAC | N/A | N/A | 439446 | 439465 | 3542 |
| 1342044 | TGGATCCAGTCAATTCAATA | 6022 | 6041 | 460275 | 460294 | 3543 |
| 1342045 | TCAATTCAATACTCGAAGTA | 6013 | 6032 | 460266 | 460285 | 3544 |
| 1342046 | GGATCCAGTCAATTCAATAC | 6021 | 6040 | 460274 | 460293 | 3545 |
| 1342050 | CAATGACTCTTCACTCATGT | N/A | N/A | 440235 | 440254 | 3546 |
| 1342051 | ACTATTTTCAACTCAAGCTG | N/A | N/A | 439428 | 439447 | 3547 |
| 1342052 | GACTCTTCACTCATGTTTAT | N/A | N/A | 440231 | 440250 | 3548 |
| 1342053 | GGTACTGGCTCATCAGTTGT | N/A | N/A | 444368 | 444387 | 3549 |
| 1342054 | AATGACTCTTCACTCATGTT | N/A | N/A | 440234 | 440253 | 3550 |
| 1342055 | AGCAATGACTCTTCACTCAT | N/A | N/A | 440237 | 440256 | 3551 |
| 1342057 | AAGCAATGACTCTTCACTCA | N/A | N/A | 440238 | 440257 | 3552 |
| 1342060 | AACCAATCTATCACACCAAT | N/A | N/A | 444348 | 444367 | 3553 |

TABLE 53-continued 5-10-5 MOE gapmers with mixed PO/PS internucleoside
linkages complementary to human ATXN1

| Compound Number | SEQUENCE | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1342063 | AGCCATCCAAGTAAGAATAT | 5475 | 5494 | 459728 | 459747 | 3554 |
| 1342065 | ACCAATCTATCACACCAATG | N/A | N/A | 444347 | 444366 | 3555 |
| 1342066 | CAATCTATCACACCAATGCA | N/A | N/A | 444345 | 444364 | 3556 |
| 1342068 | CAGCCATCCAAGTAAGAATA | 5476 | 5495 | 459729 | 459748 | 3557 |
| 1342069 | TATTGTCACATACTAGTTCA | 4755 | 4774 | 459008 | 459027 | 3558 |
| 1342070 | CTGACTAATTTCTTGGTGAT | 7039 | 7058 | 461292 | 461311 | 3559 |
| 1342074 | GTGGTCATTTATTGTCACAT | 4764 | 4783 | 459017 | 459036 | 3560 |
| 1342075 | GTCACATACTAGTTCATAAT | 4751 | 4770 | 459004 | 459023 | 3561 |
| 1342076 | TTATTGTCACATACTAGTTC | 4756 | 4775 | 459009 | 459028 | 3562 |
| 1342032 | CCCGAGTTGTCCATAGTCAT | 4435 | 4454 | 458688 | 458707 | 3563 |
| 1342038 | CATTGTAAACGCAAAAGGCC | 7012 | 7031 | 461265 | 461284 | 3564 |
| 1342041 | CAGTCAATTCAATACTCGAA | 6016 | 6035 | 460269 | 460288 | 3565 |
| 1342042 | GTCCATAGTCATGAACTATA | 4427 | 4446 | 458680 | 458699 | 3566 |
| 1342043 | ATAGCAGCTATTTCATGACT | N/A | N/A | 439445 | 439464 | 3567 |
| 1342047 | GTCAATTCAATACTCGAAGT | 6014 | 6033 | 460267 | 460286 | 3568 |
| 1342048 | GATCCAGTCAATTCAATACT | 6020 | 6039 | 460273 | 460292 | 3569 |
| 1342049 | TAACCAATCTATCACACCAA | N/A | N/A | 444349 | 444368 | 3570 |
| 1342056 | ATGACTCTTCACTCATGTTT | N/A | N/A | 440233 | 440252 | 3571 |
| 1342058 | GACTATTTTCAACTCAAGCT | N/A | N/A | 439429 | 439448 | 3572 |
| 1342059 | CTTGGTGGTCATTTATTGTC | 4768 | 4787 | 459021 | 459040 | 3573 |
| 1342061 | GGTGGTCATTTATTGTCACA | 4765 | 4784 | 459018 | 459037 | 3574 |
| 1342062 | TAGTTGCAGCCATCCAAGTA | 5482 | 5501 | 459735 | 459754 | 3575 |
| 1342064 | TGGTGGTCATTTATTGTCAC | 4766 | 4785 | 459019 | 459038 | 3576 |
| 1342067 | GTTCAGTTTAGTTGCAGCCA | 5490 | 5509 | 459743 | 459762 | 3577 |
| 1342071 | CATACTAGTTCATAATTCAC | 4747 | 4766 | 459000 | 459019 | 3578 |
| 1342072 | TCGCCCTGACTAATTTCTTG | 7044 | 7063 | 461297 | 461316 | 3579 |
| 1342073 | CCCTGACTAATTTCTTGGTG | 7041 | 7060 | 461294 | 461313 | 3580 |
| 1342077 | GCCCTGACTAATTTCTTGGT | 7042 | 7061 | 461295 | 461314 | 3581 |

The compounds in table 54 are 5-10-5 MOE gapmers with mixed internucleoside linkages. The gapmers are 20 nucleosides in length, wherein the central gap segment consists of ten 2'-β-D-deoxynucleosides, the 5' wing segment consists of five 2'-MOE nucleosides, and the 3' wing segment consists of five 2'-MOE nucleosides. The sugar motif of the gapmers is (from 5' to 3'): eeeeedddddddddddeeeee; wherein 'd' represents a 2'-β-D-deoxyribosyl sugar moiety, and 'e' represents a 2'-MOE sugar moiety. The gapmers have an internucleoside linkage motif of (from 5' to 3'): sssosssssssssssosss; wherein "s" represents a phosphorothioate internucleoside linkage and "o" represents a phosphodiester internucleoside linkage. All cytosine residues are 5-methylcytosines.

TABLE 54

5-10-5 MOE gapmers with mixed PO/PS internucleoside linkages complementary to human ATXN1

| Compound Number | SEQUENCE | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1364280 | ACCCGAGTTGTCCATAGTCA | 4436 | 4455 | 458689 | 458708 | 582 |
| 1364281 | CCACGCTTTTATTTTCTGAT | N/A | N/A | 439093 | 439112 | 2074 |
| 1364282 | GCCTTTATAACTTTTCTTTC | N/A | N/A | 446680 | 446699 | 2552 |
| 1364283 | GGTCATTTATTGTCACATAC | 4762 | 4781 | 459015 | 459034 | 194 |
| 1364285 | ATTTTCTTTTTCTGTGCCT | N/A | N/A | 452653 | 452672 | 488 |
| 1367569 | TTCCTCTTACCATCAAAGGC | 5906 | 5925 | 460159 | 460178 | 2502 |
| 1367572 | CGTGGGTGTTCGCTCTCTCC | 4256 | 4275 | 458509 | 458528 | 3582 |
| 1367573 | GCGTGGGTGTTCGCTCTCTC | 4257 | 4276 | 458510 | 458529 | 3583 |
| 1367575 | CTCTTACCATCAAAGGCTAA | 5903 | 5922 | 460156 | 460175 | 3584 |
| 1367576 | CCTCTTACCATCAAAGGCTA | 5904 | 5923 | 460157 | 460176 | 2425 |
| 1367577 | TCCTCTTACCATCAAAGGCT | 5905 | 5924 | 460158 | 460177 | 431 |
| 1367580 | CAGCCCGTATTCCTCTTACC | 5915 | 5934 | 460168 | 460187 | 509 |
| 1367581 | TGTGGCAGCCCGTATTCCTC | 5920 | 5939 | 460173 | 460192 | 3585 |
| 1367586 | GGGTGTTCGCTCTCTCCCTC | 4253 | 4272 | 458506 | 458525 | 3586 |
| 1367588 | GTGGGTGTTCGCTCTCTCCC | 4255 | 4274 | 458508 | 458527 | 3587 |
| 1367589 | CCGTATTCCTCTTACCATCA | 5911 | 5930 | 460164 | 460183 | 3588 |
| 1367590 | GTATTCCTCTTACCATCAAA | 5909 | 5928 | 460162 | 460181 | 3589 |
| 1367591 | CCCGTATTCCTCTTACCATC | 5912 | 5931 | 460165 | 460184 | 3590 |
| 1394153 | CCCGAGTTGTCCATAGTCAT | 4435 | 4454 | 458688 | 458707 | 3563 |
| 1394154 | GCACCCGAGTTGTCCATAGT | 4438 | 4457 | 458691 | 458710 | 3605 |
| 1394155 | CACCCGAGTTGTCCATAGTC | 4437 | 4456 | 458690 | 458709 | 3593 |
| 1394156 | GTCAGGTATTTGTTCAGTTT | 5501 | 5520 | 459754 | 459773 | 3402 |
| 1394157 | TGTTCAGTTTAGTTGCAGCC | 5491 | 5510 | 459744 | 459763 | 274 |
| 1394158 | TTGTTCAGTTTAGTTGCAGC | 5492 | 5511 | 459745 | 459764 | 3655 |
| 1394159 | GTTCAGTTTAGTTGCAGCCA | 5490 | 5509 | 459743 | 459762 | 3577 |
| 1394160 | TCAGGTATTTGTTCAGTTTA | 5500 | 5519 | 459753 | 459772 | 3331 |
| 1394161 | GCCCGTATTCCTCTTACCAT | 5913 | 5932 | 460166 | 460185 | 2579 |
| 1394507 | GGTGGTCATTTATTGTCACA | 4765 | 4784 | 459018 | 459037 | 3574 |
| 1394508 | GTGATTGTGTTCCATTGTAA | 7024 | 7043 | 461277 | 461296 | 201 |
| 1394510 | CCTTGCACTTTTGTTTCTAC | N/A | N/A | 441090 | 441109 | 321 |
| 1394511 | GTGGTCATTTATTGTCACAT | 4764 | 4783 | 459017 | 459036 | 3560 |
| 1394512 | ATGTGTTCTTAAATTCTCTA | 8210 | 8229 | 462463 | 462482 | 1583 |
| 1394513 | GCACGGTATTAGTGTCTTCA | 7892 | 7911 | 462145 | 462164 | 126 |
| 1394514 | GCTTCTCAAATCAGGTGTAC | 8481 | 8500 | 462734 | 462753 | 1045 |
| 1394515 | TGATTGTGTTCCATTGTAAA | 7023 | 7042 | 461276 | 461295 | 3533 |
| 1394516 | GTTTGTTGGTTTCTTATTAA | 7083 | 7102 | 461336 | 461355 | 46 |

TABLE 54-continued 5-10-5 MOE gapmers with mixed PO/PS internucleoside linkages complementary to human ATXN1

| Compound Number | SEQUENCE | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1394517 | CTGTATATTTATTACTTGAT | 8228 | 8247 | 462481 | 462500 | 1891 |
| 1394518 | TGGTCATTTATTGTCACATA | 4763 | 4782 | 459016 | 459035 | 3038 |

The compounds in table 55 are 6-10-4 MOE gapmers with mixed internucleoside linkages. The gapmers are 20 nucleosides in length, wherein the central gap segment consists of ten 2'-β-D-deoxynucleosides, the 5' wing segment consists of six 2'-MOE nucleosides, and the 3' wing segment consists of four 2'-MOE nucleosides. The sugar motif of the gapmers is (from 5' to 3'): eeeeeedddddddddddeeee; wherein 'd' represents a 2'-β-D-deoxyribosyl sugar moiety, and 'e' represents a 2'-MOE sugar moiety. The gapmers have an internucleoside linkage motif of (from 5' to 3'): sooooossssssssssoss; wherein "s" represents a phosphorothioate internucleoside linkage and "o" represents a phosphodiester internucleoside linkage. All cytosine residues are 5-methylcytosines.

TABLE 55

6-10-4 MOE gapmers with mixed PO/PS internucleoside linkages complementary to human ATXN1

| Compound Number | SEQUENCE | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1371806 | GTTCGCTCTCTCCCTCTCCC | 4249 | 4268 | 458502 | 458521 | 114 |
| 1371807 | TTTTCTTTTCGCCCTGACTA | 7052 | 7071 | 461305 | 461324 | 3591 |
| 1371808 | TCATTTATTGTCACATACTA | 4760 | 4779 | 459013 | 459032 | 3592 |
| 1371809 | CACCCGAGTTGTCCATAGTC | 4437 | 4456 | 458690 | 458709 | 3593 |
| 1371810 | GTCATTTATTGTCACATACT | 4761 | 4780 | 459014 | 459033 | 3594 |
| 1371811 | TTTTTTCTTTTCGCCCTGAC | 7054 | 7073 | 461307 | 461326 | 3595 |
| 1371812 | GTTGTCCATAGTCATGAACT | 4430 | 4449 | 458683 | 458702 | 3596 |
| 1371813 | TAATTCACATTCATCCCTTT | 4735 | 4754 | 458988 | 459007 | 3597 |
| 1371814 | CCCTGACTAATTTCTTGGTG | 7041 | 7060 | 461294 | 461313 | 3580 |
| 1371815 | ATAATTCACATTCATCCCTT | 4736 | 4755 | 458989 | 459008 | 2268 |
| 1371816 | TGGTCATTTATTGTCACATA | 4763 | 4782 | 459016 | 459035 | 3038 |
| 1371817 | TTGTCCATAGTCATGAACTA | 4429 | 4448 | 458682 | 458701 | 2421 |
| 1371818 | AGTTGCAGCCATCCAAGTAA | 5481 | 5500 | 459734 | 459753 | 2655 |
| 1371819 | GTTCATAATTCACATTCATC | 4740 | 4759 | 458993 | 459012 | 2499 |
| 1371820 | GCCCCCAAACCCATTTTCTT | N/A | N/A | 452665 | 452684 | 1026 |
| 1371821 | CAGCCATCCAAGTAAGAATA | 5476 | 5495 | 459729 | 459748 | 3557 |
| 1371822 | TTCATAATTCACATTCATCC | 4739 | 4758 | 458992 | 459011 | 2422 |
| 1371823 | GAGAACAAAGTCTATGTGGC | 5934 | 5953 | 460187 | 460206 | 2733 |
| 1371824 | CCCGAGTTGTCCATAGTCAT | 4435 | 4454 | 458688 | 458707 | 3563 |
| 1371825 | AGCCCGTATTCCTCTTACCA | 5914 | 5933 | 460167 | 460186 | 2656 |
| 1371826 | TCCTAACACTGCACAGAAAC | 4279 | 4298 | 458532 | 458551 | 3598 |
| 1371827 | TCAGGTATTTGTTCAGTTTA | 5500 | 5519 | 459753 | 459772 | 3331 |
| 1371828 | TCCATAGTCATGAACTATAA | 4426 | 4445 | 458679 | 458698 | 3599 |

TABLE 55-continued 6-10-4 MOE gapmers with mixed PO/PS internucleoside linkages complementary to human ATXN1

| Compound Number | SEQUENCE | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1371829 | GTCAGGTATTTGTTCAGTTT | 5501 | 5520 | 459754 | 459773 | 3402 |
| 1371830 | GTGATTGTGTTCCATTGTAA | 7024 | 7043 | 461277 | 461296 | 201 |
| 1371831 | CCATAGTCATGAACTATAAA | 4425 | 4444 | 458678 | 458697 | 3600 |
| 1371832 | TTTTTCTGTGCCTCCTGACC | N/A | N/A | 452646 | 452665 | 795 |
| 1371833 | TGATTGTGTTCCATTGTAAA | 7023 | 7042 | 461276 | 461295 | 3533 |
| 1371834 | CCTGACTAATTTCTTGGTGA | 7040 | 7059 | 461293 | 461312 | 2350 |
| 1371835 | CATAGTCATGAACTATAAAC | 4424 | 4443 | 458677 | 458696 | 3601 |
| 1371836 | GAGTTGTCCATAGTCATGAA | 4432 | 4451 | 458685 | 458704 | 3534 |
| 1371837 | AAAGAAAAGTCAGGTATTTG | 5509 | 5528 | 459762 | 459781 | 3332 |
| 1371838 | GCCCTGACTAATTTCTTGGT | 7042 | 7061 | 461295 | 461314 | 3581 |
| 1371839 | ACAGAAACCAGCGTGGGTGT | 4267 | 4286 | 458520 | 458539 | 3602 |
| 1371840 | CTGACTAATTTCTTGGTGAT | 7039 | 7058 | 461292 | 461311 | 3559 |
| 1371841 | CCTCTTACCATCAAAGGCTA | 5904 | 5923 | 460157 | 460176 | 2425 |
| 1371842 | GCCCGTATTCCTCTTACCAT | 5913 | 5932 | 460166 | 460185 | 2579 |
| 1371843 | GCAGCCATCCAAGTAAGAAT | 5477 | 5496 | 459730 | 459749 | 2578 |
| 1371844 | TCATAATTCACATTCATCCC | 4738 | 4757 | 458991 | 459010 | 2345 |
| 1371845 | AGTTCATAATTCACATTCAT | 4741 | 4760 | 458994 | 459013 | 2576 |
| 1371846 | GTGTTCCATTGTAAACGCAA | 7018 | 7037 | 461271 | 461290 | 123 |
| 1371847 | ATTTTCTTTTTCTGTGCCT | N/A | N/A | 452653 | 452672 | 488 |
| 1371848 | GGTCATTTATTGTCACATAC | 4762 | 4781 | 459015 | 459034 | 194 |
| 1371849 | TCCTCTTACCATCAAAGGCT | 5905 | 5924 | 460158 | 460177 | 431 |
| 1371850 | TGGGTGTTCGCTCTCTCCCT | 4254 | 4273 | 458507 | 458526 | 270 |
| 1371851 | ACCCGAGTTGTCCATAGTCA | 4436 | 4455 | 458689 | 458708 | 582 |
| 1371852 | CTGCACAGAAACCAGCGTGG | 4271 | 4290 | 458524 | 458543 | 3603 |
| 1371853 | CATAATTCACATTCATCCCT | 4737 | 4756 | 458990 | 459009 | 3604 |
| 1371854 | GCACCCGAGTTGTCCATAGT | 4438 | 4457 | 458691 | 458710 | 3605 |
| 1371855 | TTTTTCTTTTCGCCCTGACT | 7053 | 7072 | 461306 | 461325 | 3606 |
| 1371856 | ACTGCACAGAAACCAGCGTG | 4272 | 4291 | 458525 | 458544 | 3607 |
| 1371857 | TGTGTTCCATTGTAAACGCA | 7019 | 7038 | 461272 | 461291 | 3608 |
| 1371858 | CCTAACACTGCACAGAAACC | 4278 | 4297 | 458531 | 458550 | 3609 |
| 1371859 | TTTTATCCCAGTCATTGGCC | N/A | N/A | 452682 | 452701 | 3610 |
| 1371860 | CCAGTCATTGGCCCCCAAAC | N/A | N/A | 452675 | 452694 | 3611 |
| 1371861 | GGGTGTTCGCTCTCTCCCTC | 4253 | 4272 | 458506 | 458525 | 3586 |
| 1371862 | TTTTCTGTGCCTCCTGACCT | N/A | N/A | 452645 | 452664 | 3612 |
| 1371863 | GACCTCTACCCTTGTGAGCA | N/A | N/A | 452630 | 452649 | 3613 |
| 1371864 | CACTGCACAGAAACCAGCGT | 4273 | 4292 | 458526 | 458545 | 3614 |

TABLE 55-continued 6-10-4 MOE gapmers with mixed PO/PS internucleoside linkages complementary to human ATXN1

| Compound Number | SEQUENCE | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1371865 | TTAATGAGAACAAAGTCTAT | 5939 | 5958 | 460192 | 460211 | 3615 |
| 1371866 | CATCCAAGTAAGAATATTTA | 5472 | 5491 | 459725 | 459744 | 3616 |
| 1371867 | AACACTGCACAGAAACCAGC | 4275 | 4294 | 458528 | 458547 | 3617 |
| 1371868 | AATGAGAACAAAGTCTATGT | 5937 | 5956 | 460190 | 460209 | 3618 |
| 1371869 | GCCATCCAAGTAAGAATATT | 5474 | 5493 | 459727 | 459746 | 3619 |
| 1371870 | TGTGGCAGCCCGTATTCCTC | 5920 | 5939 | 460173 | 460192 | 3585 |
| 1371871 | GTTGCAGCCATCCAAGTAAG | 5480 | 5499 | 459733 | 459752 | 3620 |
| 1371872 | CCGAGTTGTCCATAGTCATG | 4434 | 4453 | 458687 | 458706 | 3621 |
| 1371873 | CAAAGTCTATGTGGCAGCCC | 5929 | 5948 | 460182 | 460201 | 3622 |
| 1371874 | TAACACTGCACAGAAACCAG | 4276 | 4295 | 458529 | 458548 | 3623 |
| 1371875 | CCCGTATTCCTCTTACCATC | 5912 | 5931 | 460165 | 460184 | 3590 |
| 1371876 | CAGTTTAGTTGCAGCCATCC | 5487 | 5506 | 459740 | 459759 | 3624 |
| 1371877 | GTATTCCTCTTACCATCAAA | 5909 | 5928 | 460162 | 460181 | 3589 |
| 1394164 | TGTTCAGTTTAGTTGCAGCC | 5491 | 5510 | 459744 | 459763 | 274 |
| 1394165 | CCGTATTCCTCTTACCATCA | 5911 | 5930 | 460164 | 460183 | 3588 |
| 1394166 | TTCAGTTTAGTTGCAGCCAT | 5489 | 5508 | 459742 | 459761 | 3190 |
| 1394167 | TTGTTCAGTTTAGTTGCAGC | 5492 | 5511 | 459745 | 459764 | 3655 |
| 1394168 | GTTCAGTTTAGTTGCAGCCA | 5490 | 5509 | 459743 | 459762 | 3577 |
| 1394522 | GCCTTTATAACTTTTCTTTC | N/A | N/A | 446680 | 446699 | 2552 |
| 1394523 | GGTGGTCATTTATTGTCACA | 4765 | 4784 | 459018 | 459037 | 3574 |
| 1394524 | CAGCCCGTATTCCTCTTACC | 5915 | 5934 | 460168 | 460187 | 509 |
| 1394525 | GCTTCTCAAATCAGGTGTAC | 8481 | 8500 | 462734 | 462753 | 1045 |
| 1394526 | CCACGCTTTTATTTTCTGAT | N/A | N/A | 439093 | 439112 | 2074 |
| 1394527 | GTGGTCATTTATTGTCACAT | 4764 | 4783 | 459017 | 459036 | 3560 |
| 1394528 | ATGTGTTCTTAAATTCTCTA | 8210 | 8229 | 462463 | 462482 | 1583 |
| 1394529 | GCACGGTATTAGTGTCTTCA | 7892 | 7911 | 462145 | 462164 | 126 |
| 1394530 | GTTTGTTGGTTTCTTATTAA | 7083 | 7102 | 461336 | 461355 | 46 |
| 1394531 | CTGTATATTTATTACTTGAT | 8228 | 8247 | 462481 | 462500 | 1891 |
| 1394532 | CCTTGCACTTTGTTTCTAC | N/A | N/A | 441090 | 441109 | 321 |

The compounds in table 56 are 5-8-4 mixed MOE/cEt gapmers with mixed internucleoside linkages. The gapmers are 17 nucleosides in length, wherein the central gap segment consists of eight 2'-β-D-deoxynucleosides, the 5' wing segment consists of five 2'-MOE nucleosides, and the 3' wing segment consists of two cEt nucleosides and two 2'-MOE nucleosides. The sugar motif of the gapmers is (from 5' to 3'): eeeeedddddddddkkee; wherein 'd' represents a 2'-β-D-deoxyribosyl sugar moiety, 'k' represents a cEt sugar moiety, and 'e' represents a 2'-MOE sugar moiety. The gapmers have an internucleoside linkage motif of (from 5' to 3'): sssosssssssssoss; wherein "s" represents a phosphorothioate internucleoside linkage and "o" represents a phosphodiester internucleoside linkage. All cytosine residues are 5-methylcytosines.

TABLE 56

5-8-4 MOE/cEt mixed wing gapmers with mixed PO/PS
internucleoside linkages complementary to human ATXN1

| Compound Number | SEQUENCE | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1365254 | CACGCTTTTATTTTCTG | N/A | N/A | 439095 | 439111 | 3625 |
| 1365255 | CCACGCTTTTATTTTCT | N/A | N/A | 439096 | 439112 | 3626 |
| 1365258 | TTTATAACTTTTCTTTC | N/A | N/A | 446680 | 446696 | 3627 |
| 1365259 | CTTTATAACTTTTCTTT | N/A | N/A | 446681 | 446697 | 3628 |
| 1365260 | CCTTTATAACTTTTCTT | N/A | N/A | 446682 | 446698 | 3629 |
| 1365261 | GCCTTTATAACTTTTCT | N/A | N/A | 446683 | 446699 | 3630 |
| 1365262 | TCATTTATTGTCACATA | 4763 | 4779 | 459016 | 459032 | 3631 |
| 1365263 | CATTTATTGTCACATAC | 4762 | 4778 | 459015 | 459031 | 3632 |
| 1365264 | GTCATTTATTGTCACAT | 4764 | 4780 | 459017 | 459033 | 3633 |
| 1365265 | GGTCATTTATTGTCACA | 4765 | 4781 | 459018 | 459034 | 3634 |
| 1365267 | CCGAGTTGTCCATAGTC | 4437 | 4453 | 458690 | 458706 | 3635 |
| 1365268 | CCCGAGTTGTCCATAGT | 4438 | 4454 | 458691 | 458707 | 3636 |
| 1365270 | ACCCGAGTTGTCCATAG | 4439 | 4455 | 458692 | 458708 | 3637 |
| 1365271 | TCAGTTTAGTTGCAGCC | 5491 | 5507 | 459744 | 459760 | 3638 |
| 1365272 | CAGTTTAGTTGCAGCCA | 5490 | 5506 | 459743 | 459759 | 3639 |
| 1365274 | TTCAGTTTAGTTGCAGC | 5492 | 5508 | 459745 | 459761 | 3640 |
| 1365275 | TTCTTTTTCTGTGCCT | N/A | N/A | 452653 | 452669 | 3641 |

The compounds in table 57 are 5-8-4 mixed gapmers with mixed internucleoside linkages. The mixed gapmers, have mixed cEt/MOE wings and a 2'-OMe modified nucleoside at position 2 of the gap. The gapmers are 17 nucleosides in length, wherein the 5' wing segment consists of five 2'-MOE nucleosides, the 3' wing segment consists of two cEt nucleosides and two 2'-MOE nucleosides. The gap is eight nucleosides in length, and has a nucleoside comprising a 2'-β-D-deoxyribosyl sugar moiety at positions 1, 3, 4, 5, 6, 7, and 8 of the gap (counting from the 5' end) and 2'-OMe nucleoside at position 2 of the gap (counting from the 5' end). The sugar motif of the mixed gapmers is (from 5' to 3'): eeeeedydddddddkkee; wherein 'd' represents a 2'-β-D-deoxyribosyl sugar moiety, 'y' represents a 2'-O-methyl ribose sugar moiety, 'k' represents a cEt sugar moiety, and 'e' represents a 2'-MOE sugar moiety. The gapmers have an internucleoside linkage motif of (from 5' to 3'): sssosssssssss-soss; wherein "s" represents a phosphorothioate internucleoside linkage and "o" represents a phosphodiester internucleoside linkage. All cytosine residues are 5-methylcytosines.

TABLE 57

5-8-4 MOE/cEt mixed gapmers with mixed PO/PS
internucleoside linkages complementary to human ATXN1

| Compound Number | SEQUENCE | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1365278 | CGCTTTUATTTTCTGAT | N/A | N/A | 439093 | 439109 | 3642 |
| 1365281 | CCACGCUTTTATTTTCT | N/A | N/A | 439096 | 439112 | 3643 |
| 1365282 | TTTATAACTTTTCTTTC | N/A | N/A | 446680 | 446696 | 3627 |
| 1365283 | CCTTTAUAACTTTTCTT | N/A | N/A | 446682 | 446698 | 3644 |
| 1365284 | GCCTTTATAACTTTTCT | N/A | N/A | 446683 | 446699 | 3630 |
| 1365285 | CATTTAUTGTCACATAC | 4762 | 4778 | 459015 | 459031 | 3645 |

TABLE 57-continued 5-8-4 MOE/cEt mixed gapmers with mixed PO/PS
internucleoside linkages complementary to human ATXN1

| Compound Number | SEQUENCE | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1365286 | TCATTTATTGTCACATA | 4763 | 4779 | 459016 | 459032 | 3631 |
| 1365287 | CTTTATAACTTTTCTTT | N/A | N/A | 446681 | 446697 | 3628 |
| 1365288 | GTCATTUATTGTCACAT | 4764 | 4780 | 459017 | 459033 | 3646 |
| 1365289 | GGTCATUTATTGTCACA | 4765 | 4781 | 459018 | 459034 | 3647 |
| 1365290 | CCGAGTUGTCCATAGTC | 4437 | 4453 | 458690 | 458706 | 3648 |
| 1365291 | CGAGTTGTCCATAGTCA | 4436 | 4452 | 458689 | 458705 | 3649 |
| 1365292 | ACCCGAGTTGTCCATAG | 4439 | 4455 | 458692 | 458708 | 3637 |
| 1365293 | TTTCTTUTTTCTGTGCC | N/A | N/A | 452654 | 452670 | 3650 |
| 1365294 | CAGTTTAGTTGCAGCCA | 5490 | 5506 | 459743 | 459759 | 3639 |
| 1365297 | TTCTTTUTTCTGTGCCT | N/A | N/A | 452653 | 452669 | 3651 |
| 1365298 | CCCGAGUTGTCCATAGT | 4438 | 4454 | 458691 | 458707 | 3652 |
| 1365299 | TTCAGTUTAGTTGCAGC | 5492 | 5508 | 459745 | 459761 | 3653 |
| 1365300 | TCAGTTUAGTTGCAGCC | 5491 | 5507 | 459744 | 459760 | 3654 |

The compounds in table 58 are 5-8-4 MOE gapmers with mixed internucleoside linkages. The gapmers are 17 nucleosides in length, wherein the central gap segment consists of eight 2'-β-D-deoxynucleosides, the 5' wing segment consists of five 2'-MOE nucleosides, and the 3' wing segment consists of four 2'-MOE nucleosides. The sugar motif of the gapmers is (from 5' to 3'): eeeeedddddddeeee; wherein 'd' represents a 2'-β-D-deoxyribosyl sugar moiety, and 'e' represents a 2'-MOE sugar moiety. The gapmers have an internucleoside linkage motif of (from 5' to 3'): sssosssssss-soss; wherein "s" represents a phosphorothioate internucleoside linkage and "o" represents a phosphodiester internucleoside linkage. All cytosine residues are 5-methylcytosines.

TABLE 58

5-8-4 MOE gapmers with mixed PO/PS internucleoside
linkages complementary to human ATXN1

| Compound Number | SEQUENCE | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1385293 | TCAGTTTAGTTGCAGCC | 5491 | 5507 | 459744 | 459760 | 3638 |
| 1385294 | GGTCATTTATTGTCACA | 4765 | 4781 | 459018 | 459034 | 3634 |
| 1385295 | CCGAGTTGTCCATAGTC | 4437 | 4453 | 458690 | 458706 | 3635 |
| 1394533 | CAGTTTAGTTGCAGCCA | 5490 | 5506 | 459743 | 459759 | 3639 |
| 1394534 | CGAGTTGTCCATAGTCA | 4436 | 4452 | 458689 | 458705 | 3649 |
| 1394537 | GCACCCGAGTTGTCCAT | 4441 | 4457 | 458694 | 458710 | 3656 |
| 1394538 | CAGCCCGTATTCCTCTT | 5918 | 5934 | 460171 | 460187 | 3657 |
| 1394539 | CACCCGAGTTGTCCATA | 4440 | 4456 | 458693 | 458709 | 3658 |
| 1394540 | GAGTTGTCCATAGTCAT | 4435 | 4451 | 458688 | 458704 | 3659 |
| 1394541 | CCCGTATTCCTCTTACC | 5915 | 5931 | 460168 | 460184 | 3660 |
| 1394543 | AGCCCGTATTCCTCTTA | 5917 | 5933 | 460170 | 460186 | 3661 |
| 1394544 | AGTTTAGTTGCAGCCAT | 5489 | 5505 | 459742 | 459758 | 3662 |
| 1394545 | GTATTCCTCTTACCATC | 5912 | 5928 | 460165 | 460181 | 3663 |

TABLE 58-continued 5-8-4 MOE gapmers with mixed PO/PS internucleoside linkages complementary to human ATXN1

| Compound Number | SEQUENCE | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1394546 | TTCAGTTTAGTTGCAGC | 5492 | 5508 | 459745 | 459761 | 3640 |
| 1394547 | CCCGAGTTGTCCATAGT | 4438 | 4454 | 458691 | 458707 | 3636 |
| 1394548 | CGTATTCCTCTTACCAT | 5913 | 5929 | 460166 | 460182 | 3664 |
| 1394549 | TGTTCAGTTTAGTTGCA | 5494 | 5510 | 459747 | 459763 | 3665 |
| 1394550 | TATTCCTCTTACCATCA | 5911 | 5927 | 460164 | 460180 | 3666 |
| 1394551 | CCGTATTCCTCTTACCA | 5914 | 5930 | 460167 | 460183 | 3667 |
| 1394552 | GCCCGTATTCCTCTTAC | 5916 | 5932 | 460169 | 460185 | 3668 |
| 1394553 | TTGTTCAGTTTAGTTGC | 5495 | 5511 | 459748 | 459764 | 3669 |

The compounds in table 59 are 5-10-5 MOE gapmers with mixed internucleoside linkages. The gapmers are 20 nucleosides in length, wherein the central gap segment consists often 2'-β-D-deoxynucleosides, the 5' wing segment consists of five 2'-MOE nucleosides, and the 3' wing segment consists of five 2'-MOE nucleosides. The sugar motif of the gapmers is (from 5' to 3'): eeeeedddddddddeeeee; wherein 'd' represents a 2'-β-D-deoxyribosyl sugar moiety, and 'e' represents a 2'-MOE sugar moiety. The gapmers have an internucleoside linkage motif of (from 5' to 3'): sooossssssssssssooss; wherein "s" represents a phosphorothioate internucleoside linkage and "o" represents a phosphodiester internucleoside linkage. All cytosine residues are 5-methylcytosines.

Sprague Dawley rats to assess the long-term tolerability of the oligonucleotides. Sprague Dawley rats each received a single intrathecal (IT) delivered dose of 3 mg of oligonucleotide or PBS. Each animal was weighed and evaluated weekly by a trained observer for adverse events. Adverse events were defined as neurological dysfunction not typical in PBS-treated control animals, including, but not limited to: abnormal limb splay, abnormal gait, tremors, abnormal respiration, paralysis, and spasticity. Animals treated with Compound No. 994509, Compound No. 1040500, Compound No. 1041927, Compound No. 1055001, Compound No. 1371311, or Compound No. 1385293 achieved no adverse events for the duration of the study.

TABLE 59

5-10-5 MOE gapmers with mixed PO/PS internucleoside linkages complementary to human ATXN1

| Compound Number | SEQUENCE | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1371311 | CCCGTATTCCTCTTACCATC | 5912 | 5931 | 460165 | 460184 | 3590 |
| 1371320 | TGTGGCAGCCCGTATTCCTC | 5920 | 5939 | 460173 | 460192 | 3585 |
| 1371322 | CACCCGAGTTGTCCATAGTC | 4437 | 4456 | 458690 | 458709 | 3593 |
| 1371325 | GCACCCGAGTIGTCCATAGT | 4438 | 4457 | 458691 | 458710 | 3605 |
| 1394162 | TTGTTCAGTTTAGTTGCAGC | 5492 | 5511 | 459745 | 459764 | 3655 |
| 1394163 | CCGTATTCCTCTTACCATCA | 5911 | 5930 | 460164 | 460183 | 3588 |

Example 5: Tolerability of Modified Oligonucleotides Complementary to Human ATXN1 in Rats, Long-Term Assessment In separate studies run under the same conditions, modified oligonucleotides described above were tested in Example 6: Activity of Modified Oligonucleotides Complementary to Human ATXN1 in Transgenic Mice A transgenic mouse model was developed in the laboratories of Drs. Harry Orr and Michael Koob at the University of Minnesota. The construct contains human Atxn1 exon 8, intron 8 and exon 9 including the entire 3' UTR (Banfi et al. Nat. Genet. 7: 513-520, 1994) (including nucleosides 435531-464889 of SEQ ID NO:2) flanked by Frt sites for FLP recombinase and the selection marker Hygro flanked by LoxN sites for CRE recombinase. The construct was injected into mouse blastocysts. The human sequence of exon 8, intron 8 and exon 9 replace the mouse Atxn1 exon 7, intron 7, and exon 8. The Hygro cassette was removed via recombination to generate chimeric mice expressing human coding sequence exon 8 and exon 9. Human RNA expression is found in brain and spinal cord in this model. There is a one base deletion causing a stop codon at amino acid 190, so protein is not generated.

Transgenic mice described above were used to test activity of modified oligonucleotides described above.

Treatment

ATXN1 transgenic mice were treated with a single ICV bolus of 300 µg of modified oligonucleotide. A group of 3-4 mice received PBS as a negative control on each treatment day, and the PCR values were normalized to the PBS control group for mice treated on the same day. In some cases, individual mice treated with a given modified oligonucleotide were treated on different days, and the reported results for each modified oligonucleotide in the table below represent the average across 1-3 independent experiments representing 1-5 treated mice for each modified oligonucleotide.

RNA Analysis

Two weeks post treatment, mice were sacrificed, and RNA was extracted from cortical brain tissue for real-time qPCR analysis of RNA expression of ATXN1 using primer probe set RTS37573 (described herein above). Results are presented as percent change of RNA, relative to PBS control, normalized to mouse cyclophilin A. Data indicated as "n.d." (no data) means that no data are available for that tissue for that compound.

As shown in the table below, treatment with modified oligonucleotides resulted in reduction of ATXN1 RNA in comparison to the PBS control.

TABLE 60

Reduction of human ATXN1 RNA in transgenic mice

| Compound Number | ATXN1 RNA (% control) |
|---|---|
| 994334 | 88 |
| 994341 | 80 |
| 994346 | 74 |
| 994351 | 51 |
| 994366 | 99 |
| 994367 | 83 |
| 994374 | 82 |
| 994375 | 88 |
| 994398 | 30 |
| 994408 | 72 |
| 994409 | 80 |

TABLE 60-continued

Reduction of human ATXN1 RNA in transgenic mice

| Compound Number | ATXN1 RNA (% control) |
|---|---|
| 994413 | 18 |
| 994417 | 95 |
| 994418 | 54 |
| 994419 | 28 |
| 994421 | 15 |
| 994424 | 62 |
| 994429 | 63 |
| 994430 | 36 |
| 994434 | 63 |
| 994437 | 22 |
| 994442 | 76 |
| 994443 | 62 |
| 994447 | 52 |
| 994448 | 62 |
| 994449 | 58 |
| 994453 | 58 |
| 994458 | 24 |
| 994459 | 36 |
| 994460 | 50 |
| 994464 | 49 |
| 994465 | 65 |
| 994467 | 59 |
| 994468 | 43 |
| 994469 | 32 |
| 994484 | 50 |
| 994485 | 90 |
| 994486 | 37 |
| 994491 | 51 |
| 994492 | 37 |
| 994493 | 19 |
| 994494 | 26 |
| 994495 | 48 |
| 994501 | 69 |
| 994502 | 67 |
| 994503 | 63 |
| 994506 | 56 |
| 994507 | 73 |
| 994508 | 81 |
| 994509 | 33 |
| 994517 | 89 |
| 994518 | 45 |
| 994520 | 48 |
| 994522 | 55 |
| 994526 | 36 |
| 994527 | 38 |
| 994539 | 63 |
| 994540 | 44 |
| 994541 | 82 |
| 994543 | 91 |
| 994545 | 59 |
| 994559 | 84 |
| 994561 | 65 |
| 994562 | 57 |
| 994564 | 73 |
| 994567 | 81 |
| 994569 | 46 |
| 994571 | 75 |
| 994809 | 57 |
| 994810 | 50 |
| 994811 | 43 |
| 994813 | 66 |
| 994819 | 46 |
| 994823 | 42 |
| 994829 | 86 |
| 994831 | 91 |
| 994836 | 94 |
| 994840 | 71 |
| 994841 | 67 |
| 994854 | 89 |
| 994856 | 72 |
| 994857 | 73 |
| 994859 | 78 |
| 994874 | 88 |

TABLE 60-continued

Reduction of human ATXN1 RNA in transgenic mice

| Compound Number | ATXN1 RNA (% control) |
|---|---|
| 994876 | 81 |
| 994877 | 42 |
| 994878 | 92 |
| 994885 | 61 |
| 994887 | 71 |
| 994895 | 52 |
| 994904 | 33 |
| 994906 | 68 |
| 994913 | 18 |
| 994921 | 51 |
| 994925 | 91 |
| 1040083 | 83 |
| 1040084 | 39 |
| 1040085 | 48 |
| 1040092 | 62 |
| 1040107 | 104 |
| 1040109 | 59 |
| 1040146 | 55 |
| 1040151 | 64 |
| 1040170 | 56 |
| 1040173 | 94 |
| 1040180 | 93 |
| 1040191 | 108 |
| 1040198 | 107 |
| 1040199 | 69 |
| 1040203 | 75 |
| 1040207 | 75 |
| 1040213 | 85 |
| 1040223 | 60 |
| 1040227 | 80 |
| 1040231 | 56 |
| 1040236 | 91 |
| 1040237 | 59 |
| 1040238 | 79 |
| 1040239 | 72 |
| 1040248 | 82 |
| 1040297 | 63 |
| 1040299 | 48 |
| 1040328 | 17 |
| 1040329 | 32 |
| 1040334 | 84 |
| 1040335 | 90 |
| 1040337 | 51 |
| 1040338 | 66 |
| 1040389 | 92 |
| 1040413 | 81 |
| 1040435 | 81 |
| 1040438 | 75 |
| 1040442 | 85 |
| 1040472 | 93 |
| 1040475 | 44 |
| 1040479 | 27 |
| 1040500 | 38 |
| 1040502 | 84 |
| 1040512 | 49 |
| 1040514 | 74 |
| 1040597 | 92 |
| 1040601 | 72 |
| 1041318 | 49 |
| 1041319 | 88 |
| 1041326 | 82 |
| 1041328 | 51 |
| 1041334 | 90 |
| 1041339 | 90 |
| 1041345 | 87 |
| 1041355 | 63 |
| 1041366 | 71 |
| 1041390 | 41 |
| 1041398 | 48 |
| 1041400 | 72 |
| 1041406 | 98 |
| 1041409 | 37 |
| 1041413 | 62 |
| 1041425 | 69 |
| 1041429 | 65 |
| 1041433 | 73 |
| 1041434 | 103 |
| 1041438 | 85 |
| 1041439 | 66 |
| 1041441 | 86 |
| 1041443 | 101 |
| 1041455 | 77 |
| 1041469 | 75 |
| 1041471 | 48 |
| 1041486 | 48 |
| 1041489 | 101 |
| 1041498 | 43 |
| 1041527 | 95 |
| 1041532 | 85 |
| 1041537 | 87 |
| 1041548 | 98 |
| 1041550 | 114 |
| 1041557 | 83 |
| 1041567 | 71 |
| 1041575 | 103 |
| 1041597 | 119 |
| 1041603 | 96 |
| 1041605 | 82 |
| 1041608 | 76 |
| 1041623 | 64 |
| 1041636 | 70 |
| 1041649 | 94 |
| 1041653 | 84 |
| 1041676 | 91 |
| 1041679 | 88 |
| 1041682 | 103 |
| 1041699 | 75 |
| 1041729 | 79 |
| 1041733 | 113 |
| 1041736 | 72 |
| 1041746 | 42 |
| 1041757 | 66 |
| 1041768 | 63 |
| 1041769 | 47 |
| 1041776 | 99 |
| 1041777 | 86 |
| 1041927 | 37 |
| 1042257 | 105 |
| 1042471 | 60 |
| 1055001 | 27 |
| 1055004 | 34 |
| 1055006 | 46 |
| 1055007 | 34 |
| 1055012 | 63 |
| 1055013 | 76 |
| 1055014 | 50 |
| 1055017 | 92 |
| 1055020 | 71 |
| 1055025 | 95 |
| 1055027 | 73 |
| 1055035 | 68 |
| 1055046 | 98 |
| 1055050 | 73 |
| 1342029 | 49 |
| 1342030 | 107 |
| 1342031 | 80 |
| 1342032 | 48 |
| 1342033 | 77 |
| 1342034 | 92 |
| 1342035 | 89 |
| 1342036 | 60 |
| 1342037 | 89 |
| 1342038 | 63 |
| 1342039 | 86 |
| 1342040 | 117 |
| 1342041 | 58 |

TABLE 60-continued

Reduction of human ATXN1 RNA in transgenic mice

| Compound Number | ATXN1 RNA (% control) |
|---|---|
| 1342042 | 80 |
| 1342043 | 95 |
| 1342044 | 78 |
| 1342045 | 101 |
| 1342046 | 83 |
| 1342047 | 86 |
| 1342048 | 64 |
| 1342049 | 88 |
| 1342050 | 107 |
| 1342051 | 80 |
| 1342052 | 98 |
| 1342053 | 87 |
| 1342054 | 106 |
| 1342055 | 97 |
| 1342056 | 86 |
| 1342057 | 99 |
| 1342058 | 55 |
| 1342059 | 97 |
| 1342060 | 107 |
| 1342061 | 86 |
| 1342062 | 73 |
| 1342063 | 68 |
| 1342064 | 68 |
| 1342065 | 76 |
| 1342066 | 98 |
| 1342067 | 25 |
| 1342068 | 58 |
| 1342069 | 83 |
| 1342070 | 94 |
| 1342071 | 88 |
| 1342072 | 82 |
| 1342073 | 77 |
| 1342074 | 74 |
| 1342075 | 43 |
| 1342076 | 86 |
| 1342077 | 69 |
| 1364280 | 36 |
| 1364281 | 48 |
| 1364282 | 41 |
| 1364283 | 26 |
| 1364285 | 29 |
| 1365254 | 65 |
| 1365255 | 62 |
| 1365258 | 123 |
| 1365259 | 121 |
| 1365260 | 94 |
| 1365261 | 49 |
| 1365262 | 76 |
| 1365263 | 69 |
| 1365264 | 43 |
| 1365265 | 34 |
| 1365267 | 44 |
| 1365268 | 44 |
| 1365270 | 49 |
| 1365271 | 28 |
| 1365272 | 38 |
| 1365274 | 46 |
| 1365275 | 51 |
| 1365278 | 81 |
| 1365281 | 71 |
| 1365282 | 92 |
| 1365283 | 83 |
| 1365284 | 92 |
| 1365285 | 76 |
| 1365286 | 79 |
| 1365287 | 61 |
| 1365288 | 71 |
| 1365289 | 72 |
| 1365290 | 69 |
| 1365291 | 55 |
| 1365292 | 45 |
| 1365293 | 94 |
| 1365294 | 65 |
| 1365297 | 96 |
| 1365298 | 53 |
| 1365299 | 75 |
| 1365300 | 51 |
| 1367569 | 80 |
| 1367572 | 53 |
| 1367573 | 44 |
| 1367575 | 99 |
| 1367576 | 89 |
| 1367577 | 52 |
| 1367580 | 46 |
| 1367581 | 42 |
| 1367586 | 66 |
| 1367588 | 59 |
| 1367589 | 19 |
| 1367590 | 80 |
| 1367591 | 21 |
| 1371311 | 24 |
| 1371320 | 66 |
| 1371322 | 79 |
| 1371325 | 48 |
| 1371806 | 52 |
| 1371807 | 70 |
| 1371808 | 78 |
| 1371809 | 62 |
| 1371810 | 50 |
| 1371811 | 74 |
| 1371812 | 89 |
| 1371813 | 112 |
| 1371814 | 70 |
| 1371815 | 76 |
| 1371816 | 51 |
| 1371817 | 62 |
| 1371818 | 35 |
| 1371819 | 49 |
| 1371820 | 68 |
| 1371821 | 62 |
| 1371822 | 60 |
| 1371823 | 90 |
| 1371824 | 60 |
| 1371825 | 29 |
| 1371826 | 70 |
| 1371827 | 59 |
| 1371828 | 63 |
| 1371829 | 32 |
| 1371830 | 60 |
| 1371831 | 86 |
| 1371832 | 84 |
| 1371833 | 81 |
| 1371834 | 89 |
| 1371835 | 92 |
| 1371836 | 111 |
| 1371837 | 96 |
| 1371838 | 90 |
| 1371839 | 81 |
| 1371840 | 87 |
| 1371841 | 83 |
| 1371842 | 29 |
| 1371843 | 71 |
| 1371844 | 59 |
| 1371845 | 73 |
| 1371846 | 62 |
| 1371847 | 82 |
| 1371848 | 38 |
| 1371849 | 72 |
| 1371850 | 78 |
| 1371851 | 49 |
| 1371852 | 89 |
| 1371853 | 66 |
| 1371854 | 37 |
| 1371855 | 36 |
| 1371856 | 77 |
| 1371857 | 76 |

TABLE 60-continued

Reduction of human ATXN1 RNA in transgenic mice

| Compound Number | ATXN1 RNA (% control) |
|---|---|
| 1371858 | 104 |
| 1371859 | 94 |
| 1371860 | 98 |
| 1371861 | 86 |
| 1371862 | 75 |
| 1371863 | 68 |
| 1371864 | 81 |
| 1371865 | 87 |
| 1371866 | 58 |
| 1371867 | 83 |
| 1371868 | 85 |
| 1371869 | 70 |
| 1371870 | 46 |
| 1371871 | 60 |
| 1371872 | 56 |
| 1371873 | 78 |
| 1371874 | 77 |
| 1371875 | 17 |
| 1371876 | 39 |
| 1371877 | 48 |
| 1385293 | 31 |
| 1385294 | 25 |
| 1385295 | 27 |
| 1394153 | 41 |
| 1394154 | 65 |
| 1394155 | 49 |
| 1394156 | 40 |
| 1394157 | 30 |
| 1394158 | 33 |
| 1394159 | 24 |
| 1394160 | 30 |
| 1394161 | 29 |
| 1394162 | 45 |
| 1394163 | 35 |
| 1394164 | 42 |
| 1394165 | 43 |
| 1394166 | 43 |
| 1394167 | 28 |
| 1394168 | 33 |
| 1394507 | 46 |
| 1394508 | 63 |
| 1394510 | 66 |
| 1394511 | 77 |
| 1394512 | 54 |
| 1394513 | 38 |
| 1394514 | 73 |
| 1394515 | 87 |
| 1394516 | 72 |
| 1394517 | 91 |
| 1394518 | 73 |
| 1394522 | 40 |
| 1394523 | 86 |
| 1394524 | 32 |
| 1394525 | 43 |
| 1394526 | 8 |
| 1394527 | 68 |
| 1394528 | 71 |
| 1394529 | 38 |
| 1394530 | 38 |
| 1394531 | 65 |
| 1394532 | 42 |
| 1394533 | 38 |
| 1394534 | 66 |
| 1394537 | 45 |
| 1394538 | 54 |
| 1394539 | 58 |
| 1394540 | 59 |
| 1394541 | 67 |
| 1394543 | 46 |
| 1394544 | 43 |
| 1394545 | 66 |
| 1394546 | 26 |
| 1394547 | 53 |
| 1394548 | 88 |
| 1394549 | 51 |
| 1394550 | 92 |
| 1394551 | 48 |
| 1394552 | 33 |
| 1394553 | 85 |

Example 7: Activity of Modified Oligonucleotides Complementary to Human ATXN1 in Transgenic Mice, Multiple Doses Modified oligonucleotides described above were tested in the ATXN1 transgenic mice described herein above.

Treatment

ATXN1 transgenic mice were divided into groups of 3-4 mice each. Each mouse received a single ICV bolus of modified oligonucleotide at the doses described in the tables below and were sacrificed two weeks later. A group of 4 mice received PBS as a negative control for each experiment. Each table represents a separate experiment.

RNA Analysis

After two weeks, mice were sacrificed, and RNA was extracted from cortical brain tissue for real-time PCR analysis of measurement of RNA expression of ATXN1 using primer probe set RTS37573. Results are presented as percent change of RNA, relative to PBS control, normalized to mouse cyclophilin A (measured by primer-probe set m_cyclo24 described herein above). ED50 values were calculated in GraphPad Prism. N/A means that an ED50 value could not be reliably calculated for that experiment.

As shown in the tables below, treatment with modified oligonucleotides resulted in dose-dependent reduction of ATXN1 RNA in comparison to the PBS control.

TABLE 61

Dose-dependent percent reduction of human ATXN1 RNA in the cortex of transgenic mice

| Compound ID | Dose (µg) | ATXN1 RNA (% control) | ED50 (µg) |
|---|---|---|---|
| 1040479 | 10 | 97 | 669.1 |
|  | 30 | 86 |  |
|  | 100 | 87 |  |
|  | 300 | 59 |  |
|  | 700 | 51 |  |
| 1040500 | 10 | 87 | 126.2 |
|  | 30 | 83 |  |
|  | 100 | 59 |  |
|  | 300 | 44 |  |
|  | 700 | 22 |  |
| 1367591 | 10 | 80 | 40.59 |
|  | 30 | 66 |  |
|  | 100 | 32 |  |
|  | 300 | 23 |  |
|  | 700 | 22 |  |

TABLE 61-continued

Dose-dependent percent reduction of human ATXN1 RNA in the cortex of transgenic mice

| Compound ID | Dose (μg) | ATXN1 RNA (% control) | ED50 (μg) |
|---|---|---|---|
| 1371311 | 10 | 76 | 36.11 |
|  | 30 | 57 |  |
|  | 100 | 45 |  |
|  | 300 | 19 |  |
|  | 700 | 14 |  |
| 1371875 | 10 | 70 | 30.41 |
|  | 30 | 67 |  |
|  | 100 | 25 |  |
|  | 300 | 12 |  |
|  | 700 | 9 |  |
| 1394161 | 10 | 71 | 36.04 |
|  | 30 | 68 |  |
|  | 100 | 35 |  |
|  | 300 | 18 |  |
|  | 700 | 8 |  |

TABLE 62

Dose-dependent percent reduction of human ATXN1 RNA in transgenic mice

| | | Cortex | |
|---|---|---|---|
| Compound ID | Dose (μg) | ATXN1 RNA (% control) | ED50 (μg) |
| 1041409 | 10 | 94 | 277.3 |
|  | 30 | 88 |  |
|  | 100 | 78 |  |
|  | 300 | 56 |  |
|  | 700 | 34 |  |
| 1055001 | 10 | 91 | 144 |
|  | 30 | 89 |  |
|  | 100 | 75 |  |
|  | 300 | 23 |  |
|  | 700 | 18 |  |
| 1055007 | 10 | 104 | 156.9 |
|  | 30 | 88 |  |
|  | 100 | 75 |  |
|  | 300 | 31 |  |
|  | 700 | 22 |  |
| 1371827 | 10 | 92 | 87.95 |
|  | 30 | 77 |  |
|  | 100 | 50 |  |
|  | 300 | 34 |  |
|  | 700 | 22 |  |

TABLE 63

Dose-dependent percent reduction of human ATXN1 RNA in transgenic mice

| | | Cortex | |
|---|---|---|---|
| Compound ID | Dose (μg) | ATXN1 RNA (% control) | ED50 (μg) |
| 994823 | 10 | 110 | 308.3 |
|  | 30 | 96 |  |
|  | 100 | 72 |  |
|  | 300 | 64 |  |
|  | 700 | 32 |  |

TABLE 63-continued

Dose-dependent percent reduction of human ATXN1 RNA in transgenic mice

| | | Cortex | |
|---|---|---|---|
| Compound ID | Dose (μg) | ATXN1 RNA (% control) | ED50 (μg) |
| 1385293 | 10 | 90 | 93.14 |
|  | 30 | 75 |  |
|  | 100 | 63 |  |
|  | 300 | 25 |  |
|  | 700 | 15 |  |

TABLE 64

Dose-dependent percent reduction of human ATXN1 RNA in transgenic mice

| | | Cortex | |
|---|---|---|---|
| Compound ID | Dose (μg) | ATXN1 RNA (% control) | ED50 (μg) |
| 994492 | 10 | 78 | 72.25 |
|  | 30 | 72 |  |
|  | 100 | 52 |  |
|  | 300 | 41 |  |
|  | 700 | 22 |  |
| 994509 | 10 | 80 | 27.84 |
|  | 30 | 53 |  |
|  | 100 | 30 |  |
|  | 300 | 20 |  |
|  | 700 | 17 |  |

TABLE 65

Dose-dependent percent reduction of human ATXN1 RNA in transgenic mice

| | | Cortex | |
|---|---|---|---|
| Compound ID | Dose (μg) | ATXN1 RNA (% control) | ED50 (μg) |
| 1041927 | 10 | 72 | 52.22 |
|  | 30 | 71 |  |
|  | 100 | 41 |  |
|  | 300 | 29 |  |
|  | 700 | 33 |  |
| 994419 | 10 | 83 | 50.14 |
|  | 30 | 65 |  |
|  | 100 | 46 |  |
|  | 300 | 22 |  |
|  | 700 | 17 |  |

TABLE 65-continued

Dose-dependent percent reduction of human ATXN1 RNA in transgenic mice

| Compound ID | Dose (µg) | Cortex ATXN1 RNA (% control) | ED50 (µg) |
|---|---|---|---|
| 1394155 | 10 | 72 | 105.4 |
| | 30 | 70 | |
| | 100 | 60 | |
| | 300 | 41 | |
| | 700 | 40 | |

SEQUENCE LISTING (3669 sequences)

SEQ ID NO: 1 - DNA, 10636 bp, Homo sapiens
gaggagagagcagagtataccgcagacatcatttctactacagtggcggagccgtacaggacctgtttcactgcagggggatccaaaacaagccccgtggagcagcagccagagcaacagcagccgcaagacattgtttctctccctctgcccccccttccccacgcaaccccagatccatttacactttacagttttacctcacaaaaactactacaagcaccaagctccctgatggaaaggagcatcgtgcatcaagtcaccagggtggtccattcaagctgcagatttgtttgtcatccttgtacagcaatctcctcctccactgccactacagggaagtgcatcacatgtcagcatactggagcatagtgaaagagtctattttgaagcttcaaacttagtgctgctgcagaccaggaacaagagagaaagagtggatttcagcctgcacggatggtcttgaaacacaaatggtttttggtctaggcgttttacactgagattctccactgccaccctttctactcaagcaaaatcttcgtgaaaagatctgctgcaaggaactgatagcttatggttctccattgtgatgaaagcacatggtacagttttccaaagaaattagaccattttcttcgtgagaaagaaatcgacgtgctgttttcatagggtatttctcacttctctgtgaaaggaagaaagaacacgcctgagcccaagagccctcaggagccctccagagcctgtgggaagtctccatggtgaagtataggctgaggctacctgtgaacagtacgcagtgaatgttcatccagagctgctgttggcggattgtacccacggggagatgattcctcatgaagagcctggatcccctacagaaatcaaatgtgactttccgtttatcagactaaaatcagagccatccagacagtgaaacagtcaccgtggaggggggacggcgaaaaatgaaatccaaccaagagcggagcaacgaatgcctgcctcccaagaagcgcgagatccccgccaccagccggtcctccgaggagaaggcccctaccctgcccagcgacaaccaccgggtggagggcacagcatggctcccgggcaaccctggtggccggggccacgggggcgggaggcatgggccggcagggacctcggtggagcttggtttacaacagggaataggtttacacaaagcattgtccacagggctggactactccccgcccagcgctcccaggtctgtccccgtggccaccacgctgcctgccgcgtacgccaccccgcagccagggaccccggtgtcccccgtgcagtacgctcacctgccgcacaccttccagttcattgggtcctcccaatacagtggaacctatgccagcttcatcccatcacagctgatccccccaaccgccaaccccgtcaccagtgcagtggcctcggccgcaggggccaccactccatcccagcgctcccagctggaggcctattccactctgctggccaacatgggcagtctgagccagacgccgggacacaaggctgagcagcagcagcagcagcagcagcagcagcagcagcagcatcagcatcagcagcagcagcagcagcagcagcagcagcagcagcagcagcacctcagcagggctccggggctcatcaccccggggtcccccccaccagcccagcagaaccagtacgtccacatttccagttctccgcagaacaccggccgcaccgcctctcctccggccatccccgtccacctccacccccaccagacgatgatcccacacacgctcaccctggggcccccctcccaggtcgtcatgcaatacgccgactccggcagccactttgtccctcgggaggccaccaagaaagctgagagcagccggctgcagcaggccatccaggccaaggaggtcctgaacggtgagatggagaagagccggcggtacggggccccgtcctcagccgacctgggcctgggcaaggcaggcggcaagtcggttcctcacccgtacgagtccaggcacgtggtggtccacccgagcccctcagactacagcagtcgtgatccttcgggggtccgggcctctgtgatggtcctgcccaacagcaacacgcccgcagctgacctggaggtgcaacaggccactcatcgtgaagcctccccttctaccctcaacgacaaaagtggcctgcatttagggaagcctggccaccggtcctacgcgctctcaccccacacggtcattcagaccacacacagtgcttcagagccactcccggtgggactgccagccacggccttctacgcagggactcaaccccctgtcatcggctacctgagcggccagcagcaagcaatcacctacgccggcagcctgccccagcacctggtgatccccggcacacagcccctgctcatcccggtcggcagcactgacatggaagcgtcgggggcagccccggccatagtcacgtcatccccccagtttgctgcagtgcctcacacgttcgtcaccaccgcccttcccaagagcgagaacttcaaccctgaggccctggtcacccaggccgcctacccagccatggtgcaggcccagatccacctgcctgtggtgcagtccgtggcctccccggcggcggctccccctacgctgcctccctacttcatgaaaggctccatcatccagttggccaacggggagctaaagaaggtggaagacttaaaaacagaagatttcatccagagtgcagagataagcaacgacctgaagatcgactccagcaccgtagagaggattgaagacagccatagcccgggcgtggccgtgatacagttcgccgtcggggagcaccgagcccaggtcagcgttgaagttttggtagagtatcctttttttgtgtttggacagggctggtcatcctgctgtccggagagaaccagccagctctttgatttgccgtgttccaaactctcagttggggatgtctgcatctcgcttaccctcaagaacctgaagaacggctctgttaaaaagggccagcccgtggatcccgccagcgtcctgctgaagcactcaaaggccgacggcctggcgggcagcagacacaggtatgccgagcaggaaaacggaatcaaccaggggagtgcccagatgctctctgagaatggcgaactgaagtttccagagaaaatgggattgcctgcagcgcccttcctcaccaaaatagaacccagcaagcccgcggcaacgaggaagaggaggtggtcggcgccagagagccgcaaactggagaagtcagaagacgaaccacctttgactcttcctaagccttctctaattcctcaggaggttaagatttgcattgaaggccggtctaatgtaggcaagtagaggcagcgtgggggaaaggaaacgtggctctcccttatcatttgtatccagattactgtactgtaggctaaaataacacagtatttacatgttatcttcttaattttaggtttctgttctaaccttgtcattagagttacagcaggtgtgtcgcaggagactggtgcatatgctttttccacgagtgtctgtcagtgagcgggcgggaggaagggcacagcaggagcggtcagggctccaggcatccccggggaagaaaggaacggggcttcacagtgcctgccttctctagcggcacagaagcagccgggggcgctgactcccgctagtgtcaggagaaaagtcccgtgggaagggtcctgcaggggtgcagggttgcacgcatgtgggggtgcacaggcgctgtggcggcgagtgagggtctctttttctctgcctccctctgcctcactctcttgctatcggcatgggccgggggggttcagagcagtgtcctcctggggttcccacgtgcaaaatcaacatcaggaacccagcttcagggcatcgcggagacgcgtcagatggcagatttggaaagttaaccatttaaaagaacatttttctctccaacatattttacaataaaagcaacttttaattgtatagatatatatttccccctatggggcctgactgcactgatatatattttttttaaagagcaactgccacatgcgggatttcatttctgctttttactagtgcagcgatgtcaccagggtgttgtggtggacagggaagcccctgctgtcatggccccacatggggtaaggggggttgggggtgggggagagggagagagcgaacacccacgctggtttctgtgcagtgttaggaaaaccaatcaggttattgcattgacttcactcccaagaggtagatgcaaactgcccttcagtgagagcaacagaagctcttcacgttgagtttgcgaaatctttttgtctttgaactctagtactgtttatagttcatgactatggacaactcgggtgccactttttttttttttcagattccagtgtgacatgaggaattagattttgaagatgagcatatattactatctttaagcatttaaaaatactgttcacactttattaccaagcatcttggtctctcattcaacaagtactgtatctcactttaaactctttggggaaaaaacaaaaacaaaaaaaactaagttgctttctttttttcaacactgtaactacatttcagctctgcagaattgctgaagagcaagatattgaaagtttcaatgtggtttaaagggatgaatgtgaattatgaactagtatgtgacaataaatgaccaccaagtactacctgacgggaggcacttttcactttgatgtctgagaatcagttcaaggcatatgcagagttggcagagaaactgagagaaaagggatggagaagagaatactcatttttgtccagtgtttttctttttaagatgaacttttaaagaaccttgcgatttgcacatattgagtttataacttgtgtgatattcctgcagtttttatccaataacattgtgggaaaggtttgggggactgaacgagcataaataaatgtagcaaaatttctttctaacctgcctaaactctaggccattttataaggttatgttcctttgaaaattcattttggtctttttaccacatctgtcacaaaaagccaggtcttagcgggctcttagaaactctgagaattttcttcagattcattgagagagttttccataaagacatttatatatgtgagcaagattttttttaaacaattactttattattgttgttattaatgttattttcagaatggcttttttttttctattcaaaatcaaatcgagatttaatgtttggtacaaacccagaaagggtatttcatagtttttaaacctttcattcccagagatccgaaatatcatttgtgggttttgaatgcatctttaaagtgctttaaaaaaaagttttataagtagggagaaatttttaaatattcttacttggatggctgcaactaaactgaacaaatacctgacttttcttttaccccattgaaaatagtactttcttcgtttcacaaattaaaaaaaaaatctggtatcaacccacattttggctgtctagtattcatttacatttagggttcaccaggactaatgatttttataaaccgttttctggggtgtaccaaaaacatttgaataggtttagaatagctagaatagttccttgactttcctcgaatttcattaccctctcagcatgcttgcagagagctgggtgggctcattcttgcagtcatactgcttatttagtgctgtattttttaaacgtttctgttcagagaacttgcttaatcttccatatattctgctcagggcacttgcaattattaggttttgtttttctttttgttttttagcctttgatggtaagaggaatacgggctgccacatagactttgttctcattaatatcactatttacaactcatgtggactcagaaaaacacacaccaccttttggcttacttcgagtattgaattgactggatccactaaaccaacactaagatgggaaaacacacatggtttggagcaataggaacatcatcataatttttgtggttctatttcaggtataggaattataaaataattggttctttctaaacacttgtcccatttcattctcttgcttttttagcatgtgcaatactttctgtgccaatagagtctgaccagtgtgctatatagttaaagctcattcccttttggctttttccttgtttggttgatcttccccattctggccagagcagggctggagggaaggagccaggagggagagagcctcccacctttcccctgctgcggatgctgagtgctggggcggggagccttcaggagccccgtgcgtctgccgccacgttgcagaaagagccagccaaggagacccgggggaggaaccgcagtgtcccctgtcaccacacggaatagtgaatgtggagtgtggagaggaaggaggcagattcatttctaagacgcactctggagccatgtagcctggagtcaacccattttccacggtcttttctgcaagtgggcaggcccctcctcggggtctgtgtccttgagacttggagccctgcctctgagcctggacgggaagtgtggcctgttgtgtgtgtgcgttctgagcgtgttggccagtggctgtggaggggaccacctgccacccacggtcaccactcccttgtggcagctttctcttcaaataggaagaacgcacagagggcaggagcctcctgtttgcagacgttggcgggccccgaggctcccagagcagcctctgtcaccgcttctgtgtagcaaacattaacgatgacaggggtagaaattcttcggtgccgttcagcttacaaggatcagccatgtgcctctgtactatgtccactttgcaatatttaccgacagccgtcttttgttctttctttcctgttttccatttttaaactagtaacagcaggccttttgcgtttacaatggaacacaatcaccaagaaattagtcagggcgaaaagaaaaaaataatactattaataagaaaccaacaaacaagaacctctctttctagggatttctaaatatataaaatgactgttccttagaatgtttaacttaagaattatttcagtttgtctgggccacactggggcagaggggggagggagggatacagagatggatgccacttacctcagatcttttaaagtggaaatccaaattgaattttcatttggactttcaggataattttctatgttggtcaacttttcgttttccctaactcacccagtttagtttgggatgatttgatttctgttgttgttgatcccatttctaacttggaattgtgagcctctatgttttctgttaggtgagtgtgttgggttttttccccccaccaggaagtggcagcatccctccttctcccctaaagggactctgcggaacctttcacacctctttctcagggacggggcaggtgtgtgtgtggtacactgacgtgtccagaagcagcactttgactgctctggagtagggttgtacaatttcaaggaatgtttggatttcctgcatcttgtggattactccttagataccgcatagattgcaatataatgctgcatgttcaagatgaacagtagctcctagtaatcataaaatccactctttgcacagtttgatctttactgaaatatgttgccaaaatttatttttgttgttgtagctctggattttgttttgttttgttttttaaggaaacgattgacaataccctttaacatctgtgactactaaggaaacctatttctttcatagagagaaaaatctccaatgcttttgaagacactaataccgtgctatttcagatatgggtgaggaagcagagctctcggtaccgaaggccgggcttcttgagctgtgttggttgtcatggctactgtttcatgaaccacaagcagctcaacagactggtctgttgccttctgaaaccctttgcacttcaatttgcaccaggtgaaaacagggccagcagactccatggcccaattcggtttcttcggtggtgatgtgaaaggagagaattacactttttttttttttaagtggcgtggaggcctttgcttccacatttgtttttaacccagaatttctgaaatagagaatttaagaacacatcaagtaataaatatacagagaatatacttttttataaagcacatgcatctgctattgtgttgggttggtttcctctcttttccacggacagtgttgtgtttctggcatagggaaactccaaacaacttgcacacctctactccggagctgagatttcttttacatagatgacctcgcttcaaatacgttaccttactgatgataggatcttttcttgtagcactataccttgtgggaatttttttttaaatgtacacctgatttgagaagctgaagaaaacaaaattttgaagcactcactttgaggagtacaggtaatgttttaaaaaattgcacaaaagaaaaatgaatgtcgaaatgattcattcagtgtttgaaagatatggctctgttgaaacaatgagtttcatactttgtttgtaaaaaaaaaaaagcagagaagggttgaaagttacatgtttttttgtatatagaaatttgtcatgtctaaatgatcagatttgtatggttatggcctggaagaattactacgtaaaaggctcttaaactatacctatgcttattgttatttttgttacatatagccctcgtctgagggaggggaactcggtattctgcgatttgagaatactgttcattcctatgctgaaagtacttctctgagctcccttcttagtctaaactcttaagccattgcaacttctttttcttcagagatgatgtttgacattttcagcacttcctgttcctataaacccaaagaatataatcttgaacacgaagtgtttgtaacaagggatccaggctaccaatcaaacaggactcattatggggacaaaaaaaaaaattatttcaccttctttccccccacacctcatttaaatggggggagtaaaaacatgatttcaatgtaaatgcctcattttattttagttttattttgatttttatttaatataaagaggccagaataaatacggagcatcttctcagaatagtattcctgtccaaaaatcaagccggacagtggaaactggacagctgtggggatattaagcacccccacttacaattcttaaattcagaatctcgtcccctcccttctcgttgaaggcaactgttctggtagctaactttctcctgtgtaatggcgggagggaacaccggcttcagtttttcatgtccccatgacttgcatacaaatggttcaactgtattaaaattaagtgcatttggccaataggtagtatctatacaataacaacaatctctaagaatttccataacttttcttatctgaaaggactcaagtcttccactgcagatacattggaggcttcacccacgttttctttccctttagtttgtttgctgtctggatggccaatgagcctgtctccttttctgtggccaatctgaaggccttcgttggaagtgttgtttacagtaatccttaccaagataacatactgtcctccagaataccaagtattaggtgacactagctcaagctgttgtcttcagagcagttaccaagaagctcggtgcacaggttttctctggttcttacaggaaccacctactctttcagttttctggcccaggagtggggtaaatcctttagttagtgcatttgaacttgatacctgtgcattcagttctgtgaatactgccctttttggcggggtttcctcatctccccagcctgaactgctcaactctaaacccaaattagtgtcagccgaaaggaggtttcaagatagtcctgtcagtatttgtggtgaccttcagattagacagtcttcatttccagccagtggagtcctggctccagagccatctctgagactcgtactactggatgttttaatatcagatcattacccaccatatgcctcccacaggccaagggaaaacagacaccagaacttgggttgagggcactaccagactgacatggccagtacagaggagaactagggaaggaatgatgttttgcaccttattgaaaagaaaattttaagtgcatacataatagttaagagcttttattgtgacaggagaacttttttccatatgcgtgcatactctctgtaattccagtgtaaaatattgtacttgcactagcttttttaaacaaatattaaaaaatggaagaattcatattctattttctaatcgtggtgtgtctatttgtaggatacactcgagtctgtttattgaattttatggtccctttctttgatggtgcttgcaggttttctaggtagaaattatttcattattataataaaacaatgtttgattcaaaatttgaacaaaattgttttaaataaattgtctgtataccagtacaagtttattgtttcagtatactcgtactaataaaataacagtgccaattgca

SEQ ID NO: 2 - DNA, 468000 bp, Homo sapiens
aatattttgccatctgaaaacaaaatatttcagtactaaaggtaatgagacagtttcatgagtatggtgtttatgttggatcttgcaggaagaaatagttacagattttggtggcagtttatggctttaaacttaatggctaagaaagtaaatgacacatttcttattaattgtttttaccatttgggtaatatacatatttagcttccttgagagaacatttaaattaattgactaactgtaatctgaattatgtgttttaatttaaggttgttaaaatcacgtaaattaactgcttgtgccaacgtaaaattacaatattagcttttttttaactgaaaattatctaaatgtaagatgtctaaaaatagagtggaggtggattggacagtttgcagattatgagttggaataaaaacatcgcagttaagccaaaaacatggcaaccaatattttctgttataaaaatatttgagatgaatttagtttttatgaaagctgtctgaaactgaaatgaatagcagaagctttctgtttattcacagtccagtaataataatacctgcagcacaaagcatacgtcttttctatataaagccaacaagcttctgctcctttctgaagtcgtctttgccaagcagggtgttgggggcgggggtgaggataggggtgaggggacattttacccggttatgctcttacgtactaaccttcaccttgacaaagcttgtcaacgaaaacaaaaccagtcagagccttttcaggaaactgatgttaactgtccactagaggctgtaatgagaccaacaatgtcactttagaccaacccgaggtttaaaccgtaacaataatcgatttttaaatggaaaaaaaaaagttgtagaaatgagtaagagtgaacactagtagttatacttaaatagccacatatatgtgcatggtatttcaaaaatgtgagaaaaaaatatttccggggctctgcaccttcctcgctcgtatgtttatttttatttatgaagcacgtaggctcttgcaggccagagttgtgtaaaaactgacactttttttttggtcatcctgtgccctgcctcagttggtgactaaccgttaggtcataagtaaactcagccaaaagatctctcaaatacagcttacagtcaagattggtggctttcagaaagaaacttacgcgaaaggatcatgtttccagacacttagttctaagcacctgaagaaggtcaaatgtcgcccgacacctaccggccttccagaatcatctgcaacaagaacgccgcactgagcgcccttagtctggaggcgcctcctagtcctccaggtgccacacctgttggcaaggtgcacccatccgaagaagattccttcgcgtggaggtcacacctggcggcgagacaggcggaggggcggggtggtgggagtcggagaccgcactgaaaccctgagtccagatttaagttcctcgtcgattctcgagaactgccatttgatgctccggttgctttctctgtctcctacactggttacctcatttccgattaaattaatgatccgaaattagctgcgagaggagtgcgcgggtctcctttccaggctagagcggagtagttccatatcaaagccgatttccggacctgcgtgcgaagagagaaagagggcagggtcgggcggtcgccagcgttcgccggcaggaaaggtgagggtacctgtgcagtcgggggaccccttgaaactttccggagttgcacgcagaggcaatccccgcggcccccaggcctgggttccggaacgccgaagcgacgccggtttgtggcttaacgtgcagctgatgatcagagtgagccctctcagatgctgctccgagcgcctgggaccaaggacacgtcgggattagaatgggccgacctcccctccccgctggggtgttgcatcggctcccagctgaagcctgacagcccttgggggagtcccccaggttgcctgagtagcgccccgttgtcgttcagtcccctccaactaggtgcagggacccagggaggcgcgcgaggaccgacccgtcaccgctcaaattacctcatcgcccagctccccgcccccttcccaaacctggaaggaaccttgccctccggtccgcgtctcccctcccccgcaccccatcccgagccactctttgggaaaggtgcccgcctccccgggcggcgcgcagcgaagggttaagggcgcgggccggccgccgcgcggtgcgctcgccgtgctctgtgcggctcgccgggccgcccgccagagggtgccccccacccccatgaagtcggatccttgagctgcggcggcggcagccaactgctccatatttggcttctattacacatttacatactggagcgagcgagcgagcgagcgcgagagagcgcgagggagggagggagggcgggcgggcggagggaggagggaggggaggggagcgggaggagggggaggaggaggaggaggaggaggaggagagagcagagtataccgcagacatcatttctactacagtggcggagccgtacaggacctgtttcactgcagggggatccaaaacaagccccgtggagcagcagccagagcaacagcagccgcaagacattgtttctctccctctgcccccccttccccacgcaaccccagatccatttacactttacagtaagtgactatttttttttcctcctccgattctttcccccctcccccattcccttctccccttatttagattaaaatccctcctcccccgatctcccgagaggggcaaaagcaacaaccagcaaacaaacccaaaaccccaatcggctgcacggaaaacagctggaagaggagcgaaggaaatcgacgcgtcgtgttctgtgtgtgtgcgtgtgtgtgtgtgtgtgtgtgtatgtgtgtacatacaaccgtccccggctccaggctcccgggccgacacccccactctgggcgcaggggcggccggcgggggggctgtcaggggctgggtgggcgcccgccgggctagggggcgcgcccgggcggggggcgcgggcggggagagcggcggcggcgccccgctcccccggctgctggtccggtcgcaagtgcggagagccatgtcctcctccctccgggtggcgcaggggggaggcggcggctggggttggggggtggtccctttcccggccgccctcttcccattcctcctccccggagagggcggtgagagagagggggtctcacggagggctggacttctccgcgggtggtcgcccggcctcggcgccctggggcgggggtctcccctcggagggccggcctcgccgggtgtgcggctgcgggcggggaagggactgctcctgcagccgggacgggactttgcgcgcggccgggtgccgggcggggggcgcagaggggtggcctcggggaccgcgcgggggtagcgggtgtgcgggtgcctggagcgcggctggagtggcggtgacggccctggccgccgccgccaccgccgccctgttggtgcggccgcttcctgatcatgtgcagcggcagccgccgcccggagccgggagcccgcgagcgccccagtccgggccggcgcccccgccagcacccgcggcaggagacgaggagccgcggcaggcgctgccctgagccgggagtgaacggctgcgcggctgctgggagggtgaatgaagccaggaggaggggaaggaggaggaggcggcggccgccgcggaggaggcgctgcggggattgggatgcgccctggagccccactgctcgttcactctgggccgggccggagactctgccactcccgggggcgccgccgcctcctcctacgtggttccagtgctgcgcgcaggccggtcccgcagggggcagggaagggggccggacgggcggagcgagaggtgaggcggtgtcggagcgcggcgtgagtgtgagtgagtgtgtgagtgactgtgtgtgtgtatttgtgcgcgcgcgcgccgggcggggggcgagggccgtcgcgacgcggagggggcccttccttggctacttggctgactctgcagcgccccgacccctcttcagccccccgccttcaggctgccttcttaaactccgtggcttgtgctttcattttgtttcagaccacgtagggggctgactgaaagggatgaaacaattcaggttttctagggagattgagcaagaaccttagtgggggtggaagtagggtggtgatcgagactctgccagaaaacaaaacaaaacaaaaaaaaatccgtttctaaggacggcggggattcggttcgagcccgtggctgctctgttttgttttgctttcttggtatataatcctacagataaaagggtaatataaatatttgagaagagggaaattgctgaagagtagtaagggcaaaaaaaaaaaaaaaaaaaaaaaaaaaacagtcggaagaagctggttatataatgcgcgatgtggctaacaagaaaggcaagctatttttattttgtttaccgtatgctgtgcagtagggactcctccaaactggttctgtccccgaagagattcttagcttccctgcgagatccacaggatacaattagcaaaattagaagaccctattacacccacagaataaaaactaatgccttacagtggctttctccctgcacatcctgtcgtgcatgcacgggaatgtgtgtatgcaaataagttctcctttggcaatctagtagtcacatctcaatgacatttgtgttttataatgcaggctgtttttaatatttaaacatcattgttatatattgcacacagcagtgggtagttacttggttatttttaggcacagctagttactttttcaacagtgttagctgagacatttctgtttgggttttttaggaggctgcagttcctagaagccccccttaagcccacccttcggtttatttgatgggtaaaggtagtttgatacttgagctttttttggagtgaagcttatgtctgaggaaaccaccagagagaagagaaaatcctgcacaggaactcttggaaagggattgcaccataacggctagcgctgtggcatttaatctcctctgattgccctctcactgtgcatgcatcagtcaatattttagcagctccgcaaataaatggacttgaatgccatcttctacataaagcagaggttgaagggctcccctgaacctcctggctgcctgtcagtggtgtaggttttcggtgcacttactccagtcctgatcactcatgtaattagatcaggctgccatggcaacagacagtgttcctcgtccattcaggtgggtttgtcttgtgcctgaactactccaagtgttttatgcacagcatttatgctgcccaagccagacgagagactccactatttcaattgcatcttctttcagtcatttggatgggagacactgaatgaggcttctagctactcaacttttataaaggagaccaacaagctgttcttcctaggtgcagtatgtaaatgcatctccccagacagtgaaaggagcctgacaatcctgctggtgtttattgtgaacagatcaacaagtatttggtacttgttagaaacctttcagagctcactaaagcaacatttcttttgcagtctggtgcctttggccttgcagtcagtcacttaaccctttcaagtgtgaagagcgttcatcatttggaacctccattgcccatagcgatggctggatttctaaagggtttactcaggggaataacttattcggaaaatatattcccattgtcacattttaaaacttgacagccatcataacaaaaactggtactgacagtaggcagacattctgaatgtattcattcttaatttggatctattggctgtgatttgaatgatctttggtagtaagttaaaaggatttttttttccttagctaagcgagaaacgatagaggcctatagctagaggactgatagtgcatggtgcttttggacaataaacatgtactttattttaggatgtaatttagtgagcagttagaaagcagtattctagtctttgcattagggcaccactgataaagctggctaagcaaagagaaataatattatggcaaaaaggaaaaaaggaaaagttgctttagttgctgaagctctgtgctgctcaggcaatccaactaagtggggcagggggcgggcgggggggagtattttcataaccctggtatttgaaagaaaagataattgagaattatgtcttgatttagttgtgactgccagtcagtttacaattttatggccaacaaagctaaactggtaaattttttcccccagggctaggattgagagagctactcaactctattcccagggggtttatgagtttttaccgttttgtgagtttatgtggttggtaaattcattgtggcctggtcagatgaagcactgctgtagttaaaatgagctattatttcttctagctactcaacttttataaggtggtaaatagatgggaagcaaggatgtcaatattacacaatgccttggaggtcctggattctattttgcaacatatagaaaaatgctttacttgcagtaaaatgtgaacatatatttttcagtgcacaaataaattcatgtgaaaataagtataaaaaaatgtacctggtgggaaccgccaaaggcaatatttttccttgcggatttcgttttaagagggtttggtaaacagaagtgacactttgtcaaaaatgttacgactagacttcaggacttctgaattgtcttttacacttagaggaagattaaacagaaactctttagccacaagattacatgtcaaatgcctgtaagtttcaacatacctaagtcagttgcctaggagtcctgggaaaggccagtgctgagattattgaaatattagtaaacattactatgactcctgtttttgttgtcattatggagtccaaggacgcacatttctttgaataatgttgtgcctttattgtttttcattctgaaatgtcaagtggattttacttttttgcacataccttgagtgacagtttctgatgactaacactaacactcattttgtttcctattaaaagttaagcaataaacatattttactaaaattctgaaactcacgtaagtaggtaaatgtgggagtgaatgttaattctttaaactgtagttatctgaaaataacacatagattaggatctgaacagcttaaatacttgcatcggtaaagtgacaatagtgaagtaagacaggctattatttttaggggagagatagattatttgactttccttgctctgtattttcagagtaattcaatagttcgaatgattagtttctgtgagagatttagatctgtgcagcttaattgcttcaaataacagatttagttctggtcatacttccaaggttatcagaagcaggccctccttattttgataaaagcattgaaagcaatacattgtagaaatggtaatagaaataataatttctgttttaggaccttacatatagaacttccttttctaagataagaattttaagtcatcaattatgttcacattttattttcatgtaatttagtttaataaaataaatgtactcattcaaaatttttttaagaagtgatatacagtgtcagttttacagaattttttaaatgttggctgaaagaacggtaattacattgagatttttaaaaatatataaatgcttaaaattacagaagtaataaaaagaatggttttagacaaatcttatggaaagttttttattttattcttttataattatatttatggatatttgtctttattagtgtagtaatatattttataacgctcataatttgaactttcaggctaatgtactataaatatttgtattacgcattactaccatcccaaatgtaccaaaacacgtttagagagaacaattatggacaaaaaagcaacaagcattatattttgtttgacatatttcatgttagcagaaatgtttcattgatttttctgtaacttttaatgcatcccatttgtggagtaatgaaaatgtaatgataattgccacaatgtaagcaaaaattgtatcctacctgaaaattactttccagaaaattcatggtagtgtactcagaatttgagactcaagagggcagaggtttccccgattgtgatgttttgatttgggctaagaggaactctttttttttttttttacacttaggtgccctttaacatgacaagttttgaatgagttaggtagcagaagtttttcgtgacagttattgtagctactaacctatagcatctatccttctaacgttcaaagaaaatatatttttctgtcactgtgtatggcaaactttattttcttgtgcccttaattttgttcccctttctcacattatctcctggtacttactgaccattacctcagttttgtttaggccgtctttcttgttaatcttccaatattaatagtattgtattatgttgctctgctgggttttaaaaatattgagtattccatttttggtgtatattattgtataaaatgtcctataaattattttctggtatattattttgtaagtttttgcagtgaatacgtgctgccttgcttgtattcttgccttcttccctctgatggaatacaagttatgtaaactctctgtattatcctaactagtgcagcaacacaaatacttttgaaataagaaagcatactcatgcaagagtaaagtaatcttctatggcatttacatcatgtttgaccctcctctgcacttcagcaaactaggaggaggttgtaacttggactctataaaaccttatctgccaggtgatatgtaaacaggattgtgtgcacacacattgtcatataggcaaacactctcccaactggtgagctcataaaaagcactgtctgtaaatttatggtacctgcacctcatttgagaatcaagtattttgatgcttaatttgagatgacatcatgatcctccctccctgcttcctcatccttaaagaagtactaagattaaatagaattttgtcaacttctacttaacttggccattatttatatttgtaactcaacaggcttcttggtggagggactgtgccttctaaagatctgaaagaccttatagtgtataacagcttaccttccttctctgtacgcacagatcacatgtggggaaaccaaggactacaagaattccttcttttgcatatcagtcctcggcaggcaatcaatgcttaaataaatgcttggtgaatggattagttagaagtaagaacattttggctactgttcattactttgaaaagtgctggaaagaagtggaagttattttcctttccagctgggctgtgctcttaaaaatagtgagtgtgtatggatgaaaataatcatgagtaccgagatgtgttgccatgtacccaaggataattggctcacttacctgtttacggattattcacattggagatcatattcatagctccagaatagtttctttctgacatccaatataaacctgggcctccttcttcctactgttacctggcgtgagcttaggaaacccaaactaagtttaaaatcagcctaagcaaatgtgcagatcagctccagtaatcaaagactgaaaatcagtccagcattcactagtttggggatgattttatagtaaccctgctactgattttaaaaaaatttttttttctgtttaatgtggataattggtaattaccggtatttaagaatataattttaatggatagggctaaaaaaatacgttagcagatcgagtcctcaacttcttccgtttctatgcataggttttacctcacaaaaactactacaagcaccaagctccctgatggaaaggtatatggaagattcattcattctttctttcattcatccattcacacattcactcattcatcatacaatggaaaatttttacttaaccatgtgcaaggaattgtggcaaaatgaaaatgagatgtacattcagtatttaaataaagtttagtggaaagtttagtgaatataaatgcacactttacactttttttctgcattttttcctttcttctattccattggactggtatgctaatagctgtgcactttcatcattgtgtttcaagttgcatgttgatagataatatatgccacattaaaattaggctttggctcaattactattcaatccatgcccattttcacctgatactccttgtagttaccagcatgtgtttatcagatgattggctagaatcattggagaaaagaatgacagcggctggctcaaatggggagaccatcctcttaatttgatggaagggatgacctttttgtatgttggcctccctctgagccttgttgagtaaaaccagacctgccttttgagctggctgggatctgtgtaattctcatacaacagaatgccgaatgtgatgttcttaaaatttgtatttcggtgcatagacacttaaggtggacttattttttaaagcagtctattctgtttttcattttggatttcctctcctgcactccctcgaccattgcaggagcatcgtgcatcaagtcaccagggtggtccattcaagctgcagatttgtttgtcatccttgtacagcaatctcctcctccactgccactacagggaagtgcatcacatgtcaggtgagagttttgcgatgctctctgttttccatctgaggataaagtcctgacctggaaaattgcctcctagccatgctcccttactttgttggctgttgaatatcattttctttgcaaactctgtttgggcatagtgtgggaagttgagaaattgccaagattgttttttaaaacttcgattaaagtatctatctatttggtttaatctatatgttcatgaagactttcatttgactttgcgatgattgataattgccaattggggcttgaacctcatcattttaattgtcagttttccttaatacaattaagaatgctatgctaccagatatcttaagtcacagtttttgcattttagattactgttgtagtataatatgtgcgtagcaaaacagagacctatttgtttaggggaaccagtatttgttgaatcttgaatttctttgtgtctgtttggattttacaacttcctgattttcccacgtacagtaagtttttctggcctggagagtcatgcagacatagggtgtatgcaatggtgatgactcatggttctctattgaagaaagggccagaggatattgcctcaaattaaatcaggaaggaaaaagaggtttgctagaacttggggcagtaagggcttgggaacacaagggtttgagtgtatgtaaccaagggagattgtgaaatagaaaataggggatcaatttctatttgccttggaaatggacctgcttgaaactgtgaagacagactagattagaggttcccaagcctggctaggcaacagaatcacctggagagcttaaaaaaatagaatttggagctccaccctagacttgatgaatcagaatgtttcctgctggaatcattgatctgtctaggcactgatgctccacaggtttgggaacccctgggtcggccggtcttccagcaactcttcctaagttatgttctgtagacttagttggtgagaagctcattctacttttagcaaatctcccatttgaaaatttgaattttcaaaactcatttttcaagaggtagatggatatttgctttataacaggttcatttaaacaataattgaccagatttctttgaagaaagagctgcctctttaccgtaagagccaatttttaagttacatataaattctctggcatcttagataagagcatggagctccgtaatcaacccatctggacttaagatctggagctgccactatgaccttgagtagtcctatgtcctttcaatgcctcagtttattcatgtataagatggaggtaatattagaactttcttatagggctgctgtgaggatggactggagtaaaatagtagatatactgtgggtagaatagtacctggtgtatggtttgtatcttttaacagatgctatcaagtaacttatccctcaacaggttgattgttatggtcatgttttatgatggttgctcctgaaccatacatgactagaaatatgtaaatatacctggaccttggtctttggacccaccctgtagacatctacggctctgcaaagccaaggagccttttatttgtttttgctgaattttaaattctgaatttatcacaactctctgactgatgggatgcatgtgtggtttttttttttttagattgttgtaaaatgaactgatgaattgcatgcataaatgtggttatttgtggtctgagtaaaaataaacaaaaacctgagtgactgaagtattatgcctcaggaaaaacagccaaaaaagtcccagtgggggacaaggtggaggagggaagagtcatcacagacacgatactcttgtaaaatatggaactggattccttacattttattggctgtggattagagaggtgttctttaagtggaaatgtaacctaaagttacatgcaaaggtaagcctcttaagatctacaagtgtcagctgaatgaaaaaggtagggtgggccaggcacagtggctcatgcctttaatcccagcactttgggaggctgaggtgggtgaatcacttgaggtcaggagtttgagaccagcctggccaacatgatgaaatcctgtctctactaaaaatataaaaattagccaggcattgtggcaggttcctgtaatcccagctacttgggacactgaggcaggagaatcgcttgaatcctggaggcagaggttgcagtgagcccaggtctcgccactgcactccagcctgggcgacagagtgagactccatctcaaaaaaaaaaaaaaaaaagagaggaaagaaaagaaaaaggtagagtgtcttactgctactttatctcttagggatgatactcattttaacggttatgtgctaggctgaaaatcctcacatttagatctttggggaaatagtttaattgcaaatgggttgagtacacgtgcattttttttaacctgtggtgttgaaagggagtcatttgtgataacagaaatatctcaagaattttattgtgaaaaaacaggcagcaaaaagtcatatctcttggtcaatatgggcagcttattgagaagagacctaggtttttataatatgttaggcaagtttaagtgtcttatgaatactaaaatactgacgaagtagcgcaaagtcaccttgaattttaagcgctgacattttctatgattgcatttaaagaaagcttataagcattatctaaacattttgcatcaataatggcctcattacagtcctcacgattgacggctcaacgtaggcagaaaaatagtatcattcatgttgtactcttttatattcattcagtttttttcttaaacctacattatagttctttctggttctagttattttataaatatgatacagctatagcaagttatgacctaacttgttcacagtcactatttatgtaaagaaatgattcattcatttattcattgtgaatttttttaaaactactgcatggtgctgtgggaatggaagtgaataagagctaccggaaggcagttattttcttcctggtcaggcaggggaaagaagaaactctctgaaataatgaatacgaatagaatggggttctaacagtgttctaacagtgaaggaattcagaagagtgacgctgagtaggagtgatcaggaaagactttgaggaggagggatcacttgagttgagctctgctgactagattgcatttctgtgggaagagatggatggagcatgaggaaggccatgtgtgtgtctgggacataacaagccaatgcacggtatgtaactgaccaggacattttgactgaagcctaggtgctggtggacatctgaatttctggattcgagcagacagtagagagtatgggaataaaactgccgagaggtcaagtctgaagataaatttggaggagtccttggcataaaagtgatctttgaaattgggttcttgggcctggcaaaaagtttgacacccaggagggggatgactgaattcagggatgacgtcagctggtgtagaatgtgtagagagaaggtaagaggcagcggagagtagcttcaacattgatgtggcatggccttcgtctgccttcttttcatgatctggggtgaaggaggctgggtggctggaggagttgggtgatgtatgcgtgggccataaggactcttctgcagctcaggcaccttggaaactcagtgctgaactacagttcaatgaaatcttgtcaaaacctctcttcctttaagacctttaaaaaaataggaacttgagctaattttagctaaatctaatgtgtgtgtgtataaaaatgaatgctgcgtttgaaattcagcgtatgcggtatctcgttaaacaaatgatccttctattttcctctaaacagttttattaagattttcagtgaagccctgtacgttttaacaacaattccagcatttctttgatcttttctaccgttgatttattcatctcacatgatatgcgtaaatcacaatgtgccatctacttgactctgtagcaattgttcatttgtggcaattcatttactgtactttgataaaccacattaatttgggtgtgttttgtaactttagaggattccctggaggctttctgcagactctttaaaatgtgagatgtgtgtgtttttgtgcgtgcgtgtatactgtatatacctagctactagacacagctctttgaacaatttggcttcccatttatactttatagaaaataaagagatatagaattggtgaatcttgggtctggggagaaagttagtctaagacttcctgatgtaaagtgaaagagaaggctggagatgatgttacgatgatgttagtgagcagtctgatttaatgtaatgagagaaaatttgaggattaagttgtggtttttttttttggtgctgagttagttaggatgggctctctgtgtagcccaaaagggctcagaataaaagcagtgacttatttaactttcatcaaagacaagaaggttaagacaggaacaagagggatggagcaaacaactccaggggcagatcgttcttgtctgcaattatttaatgagcatctaatgtatgagacgcattatgccaacaaggccctctagggaatatggagatgatcaatagttcacatttactattctgcatattaacttattgaatcctcattacagtcctttgaggtaggcatcattattttctccattgcacaggcgaggaaactgtggcacagagagggtgaataatttccccaaggtttcccagctgttaagtgatagaatcgtgcttggatcccagtctacactctcagccctgttccttaagccctgtccttaagaagcttacagtcgagtgcataaggcaaggcatggcttggagtaatatttaaagagccatgacacaggtaacacagtctaggaagtcaggatcaaggaagggtccttccttggagccttctcttttgatgcctgcctgtctgttcagtcacatatgagctttctgacacaggctgtcccatgcaggctttgtggtgttttctccctttctttcactcttactcatatctccttgagattcctatgcactttcaataattattaattgaagaaaatgatgacagtggcaatttgcttatccgtttcaggggattggcttaagttggatccaaatgttattcagcatcaagagtctcagcgagatgatgaacttttgactcttaaaagaacttcactgggtcattgctcagcttgcaagatttggcagatatgaactatttgtctctccagtgtgataggtggtggtgtggcgctgaacgcaagctctaagaataaaacgtgcagcaaaaggaggtcacgctttagtcagggtggccataaggaagcttagaactcacatcccctctgcccctgcctcgcccagtctcattttctctccttcactagaacagtgaatgaatctgagctcattcatgtcaagatgatagagaagaaagatcactttctcttagctggcttagggaaggccagattgtctttcttacactgagtgaaaaattactgaggacttttgttttttttttttttggtcttcaaggcaacatctcttgcttttacagacccacggaaatcgagaagaggatgcaagatttactattcgtgccctagcctggcagcttcagcctacatcacagctgtaatcatatgtgatgcatttttatttacagattagtaggctctgactctgacatatgactaaccgggaagctcctccctgtaacagttgtatgtcgtctgcttcagagaactaattgcttggcaattcccctttggtaattccctctttattttctgatgagttacttaacagcgatgggcttgttgagcagagcgtggagtttaatgtgtgctccagaaactccactgtaggcctgggggatatgtttttcgagttctgtttagctttactgaaggaacagtgaaaccattatatggcctgttaatatttcactcaataccagattaaacaccgagcagcgtgcagttttccaaaagaaatcaaaaccaggcttctttttaaaatgtgcccctgtgcattagaaaattattaaaaaggaatttaatatgtatagaatgtttaatgatcttttgaaaatatggtttcaaatggagtagtcttccaggaccctacagagtgagtatggtgtgctgttggactggtagtttggaggctcagtttctgttgcctgccctgcaacaggatgacttgtgctactcactgtaccttgctgggtctcagttttcctgtctccaaaacacaaggaggttgaaagaaatgatctctcgggactcttctatctctgacattgtacagttccatgaatagattttattgtaattcttgctcccggctcccccaagacctttgcttctgtcaaacatcatttgctgttgtttgactttgttagattttgtatttaattagaatttatattttagctattattatgtcattatttatagagtaagtcataagcggtgcctaaattcatttatcaccccatctatattagtttcatacctgaatacttcctccgctcctttttactgttcttgctaccatgtcccaaacaacatccatttctggaggtggaatgcagtataactggaaagaatctttcagctgattgtgggattattttttgcaagaggagtgcagaagctctgcttttctaagcagtaatatcaagggccatattctgcttttaatttgcaagtagaaatcgttttgatgtcatttggttttacctgcaggtgcaggttttagtctctaggtaattccttttctcttctgcgtcaactttcccaattagtgtgtgcagcattgccttgtctttttggttaattcataagcagttcatacagatgcctcttgattcattgcaattattaatagtttctttaggcagctagtgcaaatagaaaaggtgacatttgagagggtttgttgttttaatttatttgtttcatagacagagagggagggtgaaaatgaaggctttaaagtcagggagattgaggcttgaatccttctggctctggctcctggctttgtggtccaggtcacattccttaaatctgtgatcctcaatttcctcatctgttgaatggggatgataatatcacctaactcacagaatcactggaaagattaaatgtgcactcactctctagatgttgcttatggtagtatctcaataactaataaaaacagacacacacacacacacacacacacacacacacacacacacggaaggcatagcatttaagagctgaataaaaaaagcaagaacaaaggaaagtgctgcatttgaggtatagtcagggtaggaggagcttctcagagcagccagttttagtaggcagagtttgaatctcaaaaggacctttgaaatttgggaaggactaagcaccctccactaacctgtcagtgacgttttctgcaggtagctcttgggaaggactaagcaccctccactaacctggcagtgacgttttccgcaggtagctctgctctacagaaaagagtgtttactacacatgactgataaaaataccatgtttttaaacatgtattgcccaaaccttacaataataaaggaaagccaataaaagcaaaagttccctttgattccaccattccagtccataaatcaagttcatttttatgtgttgttttttagttcttgatgatgtaacttatatctttttttcagttttgtgtttcccatttagcataaacattcttagtaacttcagctatacagttctcatttgcaaggatcacataacattctatcaggttgttttatcttaatttttaagtttcctatcatttttggacattcgagttgtttctaattgtttactgttgtaaagccgcagcgaatgtctttgcacacaagtatttaccgaggacacactcacatcagaaggctcaatactaagttagagggagcttgctctgaattgctttctaaaaggctgtaccaatttacattgttactaatgatataagaatgtctctagcttcaatcttaataattgtgggacttactattttttggctaatttaataggctctttggttttaaagttttcattcctttgatccctctcagagatggaacatttccatctgtgtttatttactaattgttctttttacaattagcaaatggaagtcttgatgttttctaatctatgtatatgagctctttatatgttctagatattaatccatttaaaaagtcctatttgctacagctacttccctagtccagtgtcctttcatttcagtgatgatgctttttgttgtacaacggttcaagtttttatatgatcagcctctcttttcttctacttgtacccagggccaacctggcaggaataaatgagattaccgcagctcaaattctgcaccaggctggcgagtggtccactggatggctttgctgggaatagctctttctttcttctgctcacttttccccttgggaactgtttcctgttgaagtcccagtctttctatttccaagggcccctttccccttctcccacctgcccctcactccttgattctcacccaccctgtgccggtttcctggctgtggcatcctctctgcccagttctcaaccctccgttgctgacctgtgtgtttctcagggagccctgtcctgggagcagtgggtagaaacatgtctggcagcctccctgactagggcctagagagatcagtcaggaatctcaggcctggccaaagtctaaccattatccaagtctctggggtcggggtctttacaacttctgtcttacatttctgctacgtagcaggctgccctgctaaggaatgggctccttggcgctggttttcatccatgtaggaaccagagaggcacgatgctaccctgattcctttcctgttgtagctcttctccggggatagctcttccagtggaaggttgggaacaacttcctagggattgaattttttgaggaaggctggtctcaaagtgtgagttttagctgagtggctctgctgagctggggtggtttggcatatgatatacctcctaaatggcctgtctagatgtattgttgttctggtccaacatgtttttcctctttgaagccaaaatgaacatttgttagtatttgaaatctgctgacatctctgtttttcttaactccctccctgggttctcatggtcctcaggataaagtctagaatccttagcctggctccataggttttgaggaccttccttatctctccagcctcatcactcacatgttgccctgtattcgtcccacgtcggtcccatcgcacttcctccttcaagtgccatactctgttttttgctccagcctttagacatgttgttcttcctccttagaacccagctcctctctctgcactgtctggctacctttccctcattcttgaaatctcagcttagagtctcttcctcacgaagcccttggactagggactatgttatttgctaccttttctgggttcccatagcaccccattcttccccttgtataatacttcacaacccctttcctggcccagcgataggagggactgccctctttccagtatgtggcatctagtgaatgggcaatacatacgggcattccccctgtgatgcttatgttacaaattggatgtgattccatctattaatatggactgtgatgtatataattgtggtgtgtataattgtggtcaggaaccagcatggggtcctgtgaaccacagtggtggaaaaagctatggcacctgtttgttccactggctttgtgctttgtccatcacacagtgagtgaaaaggtgacaaaaatgtgtaagaagcctgtgctaaggagaaagaaaggtccaatgatgaattttctggaaagaaagctgtacgtaatagagtgctgaattcgctcaatcatatttaagttttatagtactgcacttataaccacacaaaacactattattattgaaattcaatacaggaaaaatgcttttgtttttgaacgtctaagactgtcttcctcctcattgaaaaaattcctactgaatttcgattatatgaagatttttagaaatgcagctattgcatcgaatgaataaatgaatttgaggttcacgttcttaacatctgttttctgactttgatcagtctcctttaagtgctctcgtggtcatactctgcaactcaggtgaaagtttctagtgagatagttatcccaaggagatacttttatctggaagagagtagttctgaagttctaagtgaggttggttggttagatttaggttaaggtaccacatggaaaggagaactgcttaaaggggtagggtgaccatgaaaccttcttctgcaaaccctgctcgtcaagtatgaaaccggtggggtaggaggtccatctaatcttatctgtgcccttttgagttggccggccgggtgaccatccatctcctctgggttgtaaatgacttcatctcgaagttgcactgttggtggtaggtgaggacgccttctccaggtggagggagtgcatttgtggttgatggtgtgagcgaccatatgttggaccatatgtcagaacctgttaagagattctgacaggtatggaaatgcctcccattggaaactgaagccctgggtcctttgaccgctgcagcacccccagaggagagtaccctaaggcccttttaaccttgccctgccctggcaggttccaaggggaggcagaaatgactctggatgaattttgttttgattattcttccccttttccaggctctgtgtccagttcacctctggagctgcctgggtcactgcaacccagactagagagaagtatgaccccaagttgtggcttttattgggagacagccttcatctaaggaagtgggaaagaatgtgttccccagctgctgcctttctggtgtctgatctgatacttttcaaaagatagcagttttgtttggtttgatttggattttttttttcttttgtaagtggtcatagacccataagacaagtttattattgtattgacagaagaaaaaaatgccatggttatttatttaaaaatctctttccatacaactttgctttctattgagtttgaaggaaatatggtgatggcatctaagcccaaatttcggtgttttattttggctttcctgttctgtttaagcctctgtaaccccttgaacctttctctactcttcagaaggaacaagttatattttttttccatctcaacatcgtccaaatgaaccgtactattttaacaatctgtgtaaacagatataaaaggaggaagactactttctttaattttcctcccagcgagctgcaaagctgtttcagtcatcctagtgattagcagaatgtgagtaataaacaacattaaaatgaagaaacgtctttctgagtaggaccttgaaatgtgggtctcaccagtagtatatgagccttcctcagactaaactccatgacacagttcatatcatctttaagtcctggagggagggttttttaatatgtgtaaatgaccaaacacagctgttggctgtcctgctgtacagagaacattcggtgacctgaaatcgcaaagtttctgtctctgaagggtgcacttaatttaactttttgccctgaagtctcaagaaatgagacttcctttaaaaaaagtgttcttaaaactttctcattttaaatgtccagggtcttcaaagagtatactgggaggaaagtcctgtgtttcctgtttctcttgtaggactagtcaaaagtaccctttctcttgatggtattctgcagtctgagcctctgatttagtaactacagcctttaaaaccacagttatccagaccatgtgcagtggttaatgtgtcatgagtctgcctcagctgataatagcacatcacagaattcagagtgccttagataaattgtttcagtggatagtcataatgactgcttgagtagaaaagtaccctcattttctaggggagaaaacagaacctacgaggttgactgatttactagattccagtggttagaaatacatgtagcctgtgctgtaaacctgattttctgacttgtagttcagctctcttctccatctccttgtacagccaagataccccagaaattatttgcgtttccgaagttgtaggatgaaaagacatgtctttgcttaactgagttagccccctagaacaatattgagatggagctggaatggtgaagaaatgcaagagtccaatcccttgggtatgtgcaattcccagttaccccttgaaacagtgcttcattataaatttagatgttagaggctgggcatggtggctcatgcctcgaatcccagtgctttgggaggccaaggcggtgggatcgcctgaggctaggagttcaagaccagcctgggccacagagtgagaccctgtctctaaaaaaaataaataaataaataaaaaattatatgttagatgtttttatagtgccggagcctaaacttgatggataaacagagaatgattttcattttgcagccactgcacctttaaagttgagctttttgaggtgtatttcctttaatgcacccatgacagcaaggttgaaaacatcaggaaatcaaattgatctcatatatggaatcttgaaatttaatgtcatctgctctgagaagtccttgtggatgggaagattgtacaatcagatcatttctctgtgtaggtatctgctgtctttctactagatgttacagaagagattagaagaagctcttccagccacctgtgaatcagctttattctgctaggcaagaaggagctggtgctggacatttgtatctgcaaaaaccatgagttacttccccaataattaagtatctactgttacaacatctagtggctaatcttttagtaaaatacactgtccatctcttggtgccagaagcaataactattatgaagccttttctttctttgcagaagtagtttgctggtgaccatattgttagttgcagaaatactcagaatctgattcacatttagacttgacagaagccagattttatatctggaaacctcattagtgaaactgcaaacaagacaaaggccatctatctctctcttaggtgccctcctcaatctctttacagcttttcccccaggagtcaaggagatacagcctggcagggacttttgcttggtgatggagtagctaagaatgtttctctctaacaggtcacagaacagaaagtgctggtggacatctcttcttgccccaagatcttcgttggaagtccccgggacttggtgtctttgccgttcaaagtgtttatgaactcgccaggaggcataatgtgtcaccattttattctgggccaccctaaaggatgacacccagcttcagagacctcctcttggacgacatccctgagaatcaatgttttagctgtcccatagtctgacgtctgtttccgaccgcttttgagctggcgcaggcttagtcattaatggccaggacgatgttaaatgttctgcctgattggcttgcagctacacaccttttgtcatttgcagagcagcaactccctcttgagctcttggggagtctttacacaaatacactagaaaaaaggcacccatccattttttttccatcttggcattagctcacaggcatagtcctgggatgacctggagtagaggcagtggaggataaattcatcttgcacagacttgtttgtgctagttctagcctgtctctcgccacagatctagcttttaaatactcaagtgattggttttgtgtaggaatgtgtggattgttggattggaagaattttctccctggatttctagtgtttacataagcagatacaaaaaaaatttgatcactgatttaaatagcagggcttattttaaaaagttatgggtgcttcaaggtggtacagaataaaaatgtcagggttttttttttttttttttttaacaagtcgtaacacaaccaaaatgtatatattaatgttttgtcaggaaagggtcaaaatggaaaatttgcaacaaagacaaactacaatagaacaagtgcaaacagaagctgacaaatatatgcccctcgttgggagttcagcccatggaatgttatgtaggacaaaaggaatggaagagatatttcagtaacattttgttctctgtcaaaaaccttctgaaatataaatctgctgtgtattggagaatggatacagcaattgattcaagttgaatagctttcatttaactagaatatcccacagaaagcagttcttgttctgacaaccatatttttgctttctttcacttaaagaaaattgaattcatgtttacatatcttatagggttgttttatggacaaagacacgggtcaaaccccatcacagtggctagtgttacaacaaatagaaacatttctaaatgaaataacatttctaagccagggccagtgcctgcagtaataatactaggttggtattatgaagccatttgcaactataaataattcagtcatagatgtgctttttttaaaatcctggttttttaaaattctagtcttttgccaatacacacacccatacacatacttcacctatttgcataatagaggaggaatatgaatatgtatataataaagtcactttattttggactttctgaaacagattaccttttttcttctcctcatgatggctccctgagttgcttccaattgttgaaattccataattacccacaaatatggatgtgcccttctaagggtcttgccatgtcaaccagcccagctgaaagctaatagccagtgttagcggtttaaggaactgagcttcagaattgagagcccccagcaaaggaagttctgtttttattctccatttctactctcctcaaggagaaattaggtgtttattgttttgttttgttttttaaattcccagatcattctggcattggtcctggattcgctgcaaatgtaatttttagcaacatctattactcctgaaatattttggctcttcgtggcctgtatgattcagtagactctgaggttttccaagtacattaaggacttaaatacagaatgtcttaaaattttagggctattgatcaagagaaagcttctcgaggaataaagttctgttaggttttagccctattctgctttcaaaattcttaactggatgccgtctattttgttttctttctgtgtttataactaatttgctacttgggtttattgttttcttacttagaaactacttttttttttgttttgtaaatgcacagcacttaaaaatataaaacagttccaaacagttccaacctgttcattgtttataccttgaccatcttttctgtcttattgctgaaccatcgcttctctttctacttctcttctgggatttcatcttgctcagctaaaattctagtgtgttattctgaatattatggctggagtttcctgaccaacttcttgcatctgagtccatttcctgtgcttaaggctgctggcattccattcactgctcctagtcaaaactgaaacttctcctgctaatgagattaggccttacaacactattaatttcttcctctctatttcttgctccattgttatttctcagagatgaaaatctatttgtcattatgagattcattttggcatcacttactaaagttcccttggatttttctgttcttcatacaccctacagcttcaaactgcaacagtcatcaactggtctttgacaaattagttgtctctacacatggtttacaatattacactagctgtttaaaaataattaagcttctttctgtgttctttgctgtgggtcaggaactttacttcctttgccatgcaacacagaagttaatcacaaatgggtcctctgaaccaaataattaaaaatagagcaaagtttctgaaccaggcggttggcagaaacgtctgtacttccatctgtgcatggttaggaaaatatttcacgatatttaaatagcatcagctttgctctcttttgtgtgagagtgtgtctgtgtgtctatgcgtaattcattgctttgaaggtttgtttgactgttagataatcatataaaaaaagttactggcaaggaaacaggaaagcaaatccaggtgttttgtgcatacattctttatttaccagtctctgtgaaggagcaatgatcttgcttttgcttttctctctgactgaaagtttttgccttgttatgtgctgcagaaaactaaataacattgcattttgactttgaaatctttatgtctcttgattttccacttacaaataacctttgctaatggctttggggagctgttcgtatgtacccgaaatgctgatgaatctatttcagtttgaagtgtggcagattaggaatttctgctctctggaaaggggatttatacctggaatatgcatcaaattcacaaacactttgcgatatacgtgcagacacatgagtgactggttttgacaggaatttaatccttcaattggatttccctttgttcttgtgagtaatcagtatctcataaaatatattcagttttggctaattgtacagctatgatacaactttaagtttctaagatgtaaattactatgtgatataaagataattcccctctagcatttttcttttgtaacagcctctttttactcctgaaaagctctttattttaaggttgatttcattctactaggagaactgttgtgttagataacaactaatgcccaataaatacactgaagggagattaggaactgttaaagaaagaacacaaagcaaatgccttaatttcgttctttcagaacgtatatatttcccaaagttgtcagttcctttatgtttctaaaaacttaccaggtaggcatattcttaatactttgataataaaattaaacactgaaatcaaagctgtagattgaacatgctcacattaagtgaaattaaggagagaggaatacatttcattattaatgtatcagtgaattctggagtttagccatgaatatcagctataatcaataacagtttgagtatttaggcagtttgtaattcatgaaatttaaatcagaagggtctttaaacatctttttgtctaatctcattttgcattcaatttaattctattttttctcagcctactatatgcagagtactatgctagcagggaaaaataatgcggaataagttgtggcccatggtttcaaacagattaatctttgattactctttgatgctttttttgtattatttgagggacagtttttttttcttttttgagatggagtctcgcactgttgcctgggctggagtgcaatggcacgatctcagctcactgcaaccttttaaaaagagttaagtggatcttcctaatgattattctttgtcaatgtaagatattaggacttaatgtattttgtgaactctgagtacacctacaggtgagtggtagatatcttcatactttaaattactgctggattttgtctgtaccccgagacagaattttggtcttctcttatatatagcagttaatattaatgaggcttccctgaaagggttcctggatattcagattcttcacacttttcttataaaccattagatttgtttcctccattcatttgggcatcttctagtgacacacggagtggctcttaaaaaagtggaacttgattgctgatagttttattcaataaatcattgttaataaatatttatttgcgatcagaaacacaaggagggagtgtacacactcagaaaagcccacaatgcagggagcctgttcttctaacaataataatggctggctggcatattgaggatttaggatgtgtcagtcactgtactaatcacttaatcctcacagtaaacctacataggtcattattatctccaccttacagatgaggtaaccgggttagtagcttgcccaaggtcacagagctagtaagtggtgggactgggcttcatgcatgccattttaaccttagaccctgtgcttttaactaattatactctattgcctaccacctgtgtcattgtagaacttgcaaaattatgttcaaaaattgtttttactaaatataaaataaaatacagtaaaatagaaatacaaaagtatattcacaaaataaatgtaaattataaaaaataagggttcagtgaacactcctttaactctacacccatattttaaaattaccatcaactggatgtcctctatgtggacctccccaatcttgtcacattcttcccacctcagaaggaaccactatagaaacatgacgttttaaaatatttttaagactaggcacggtggctcacgtctgtaatcccagcactttgagaggccaaggcaggtggattatttgaggtccatagttcgagaccagcctgaccaacatggtaaaatcctgtctttactaaaatacaaaaattagcacacgcctgtggtccccgctactcaggaggctgaggcaggagaattgcttgaacctgggaggtcgaggctgcagtgagctgagattgcaccactacactccagcctgagcgacagagtgagactccatctcaaaaaagtatacatatatttttcacgaaagtacacaaaaatgcacaccagccagatcactgtttgttttctctcctttttctcttcttttttccctactttttcatctctcatccttcttccttcttttctcgcaccatcatggagaacaaagaagaactgggtcagaacaaacctttaaaaagtgaaggcgagcgttccttgcggggatgcccagtgtcatgactagtgttgggaattcttggtgagatgacaatatttttgcctcactcaaatgaggcatgcccttccaagtaaagcatgctatgttttgtagcaaacagaacacctgagaaggatgatttcatatgactgtgccaacagatctctcacaagcttgtcaggttataattcacaaatcttaactctatagtctatagacattttttttttatatggggtctcactctgtcggttgcctaggctggagtgcagtggtgagatcttggctcactgcaatctccgcctcttgggttcaagcgattctcctgcgtcagcctccggagtggctggggtttcaccatgttggccaggctggttttgaactcctgaccacaagaaatccacctaccttggcctcccaaagtgctgagattacaggcatgagccactccacccagccagtggttctttttcatttgagatggagttttgctcttgttgcccaggctggagtgcaatggcacgatcttggctcactgtaacctctccctcccggattcaagtgattctcctgcctcagcctcccaagtagctgggattacaggcatatgccaccacacccagctaattttgtatttttagtcaagatggggtttctccatgttggtcaagctggtcttgaactcccgacctcggcctcccaaagtaccgggattataggtgtgaaccaccatgcctggcctgtttcttttttttttccaagaggtcagttctcagtctgttgtccgaactggagtgcagtggcatgatcacagctttactgcagccttgaacccttgggctcaagtgatcctcctacctcagcctcccgattagctgggactgccgctgtgcaccaccacacccaactaatttttaaaatttttttgtagagacagggtcttgctatgttgccaaagcttgtctcgaactcttggcctcaagccatcctcccgcctcggcctcccaaagtgttgggattacagacatgagctgccgtgcctggctgacttgtggttcttaatagtgtggctcttaaaatagcaaacatttttgggaaccaatgtgagggcacttcataacacaatcaaaaaccattaagtggaatatgttaagataatgtaaccttgttgttgtcccttaatgctttaatgcaggctttcagcaagtagtaatacctggtatggtgggtgtaaaactcagaatgggtcccggcatggcaggaataagagaattctttcatcggttggaaaatatgtttgaataattcactacatttaaaaaataggtaaagaggcttttggttttggttgcaaattgcactcatccatggaagtttttcaagggccatacaattctgtagatggaggtggcaatttaatgcagtcttagctgtttaggatttagaactatgttacttttaatttacttccatgaaattacaaaaacatgtaatgaagctaaaaagatttcaaaagaagcacatctagtcaaacataaaagtacttaataagggcatacatgtagaagtatattagtctttgcacatatttacatatgtatgttttggttgcttaatatttttcaagtgctgcatgcatttgtatgtgtaaatacagtgtgcaccctttatagaactagtgttgggggactcttttatcagctattatgatttggagctttatcaaatggagtgatttttttttgtgtgtgtgtgagatggagtctcactctgttacccagacttgagtggagtggtgccatctcggcttattgcaacctctgcctcctgagttcaagcaattctcctgcctcagcctccaaagtagctggaattacaggcacccattagcacgcctggttaatttttgtattttcagtagagacggggtttcaccatgttggccaggctggtctcaaactcctgacctcaagtgatccacctgcctcggcctcctaaagtgctgggattacaggcgtgagccaccacacccggccggagtgatattttccaatggtcatgattctggcctgtaacaccaagcagtataacgatgagattgaagtgtgaccatgtgcgtctgcctatttttatgttctatctcatctttttgcttggagaaaaattatgttgaaagactacagtgtgcctataaagcttcaaatatgaaaaaagagctacatatgacactttgttgcagttagtccattgtctcaaaaacatgctataaaaatatgacaactagaaaagtcttggcaaatgtagcatgagtgttgccggtttaaaagccgtgtttgagtactctaaagtacttttctgtgacagctattactataggaattggcaccagctaagaaaatttacagtttaatactttagagcaaataattgcttagggtgctttaaatagcacaggaaatgtgtagagtgtttacttgacatttgctatattgaacactaatactgaaacagattctttgaccacagagaatgccagtgtaggaggggtgggggtaggtgggagaaagaggcggagaaggaaacggcaatacaattagataaaaattaaatgacaaatgtactttttcatgatacagagatatcatggggaaaaatgcccatttgtttgatcaagtaatcttctagtgtggtagcagaaagcaaagtacagacaacttcctgggattaggttcctcctgctaaaggctgtcttcaccagaaggtcaaagccttgcagcccttggtcgctctggtttatttttcaagctcctgaaagcaagaggaatgacctccgtttttattaaaaaaaaaaaaaaaaaaaaaaaaaaaaagaaaagaaaaaaaaagcctctctcgttatctgtctaatctgcacatgcttgtgatttttttttatgacgactctgatgccctcatttctcattgcagctcagtgcttgtgatgtttttttcccctgaatgcatcttgcactcccagaatcttcttttcattcttccctggctctgttaatacgggtcttatcttagaacggggtctagtgcagtttagtgtagctcttacatgcagagcattttttttttgcacaaactgcttctcgtggattgtgattcagttgcacttaaagggaaaaatagagtatattttaggctactaaacctccttccatttgtaggcatttgagccagttatacagtgtctttcagggagttttacatgcatatgttaataaccagtggcacctgtgataggtccaggaatgtgaaattgtgcaacgttaatgacatttgtccaagcttcttccttctatcttgtcaatatgagctacttttaaatacacaaaggaattttgaaaacaccaatcaaaagtcaaaatttcaccctgcagcatggcccggcacccagaacactcagcaagaggaaggtctgtatttatggcttttccactgacttgaaatttgacctggaataaatcatgtttaacttctttatgcttcaattagcttttgaaagatatgtgtggttgtgtttagccagtggaaaggcaataactgaagttcacaacgaaaggagaacttgaagggaaattttgttaggaaagaacagtgggcaagaatacaatcttcaggcagggtgctattcctaaaaagtcttggtacacatggttcctaaggaaggtgggacattttcttataatattctttctgtattttgtagaattaagaaatatattattgtacataaatattttatattacattatatatgtataaatacatttatatatatatatatatatacatactgttttaccctttaactccagaaagctttgcgttcacacatctttttccctaacttctacctataaagggatttttagtgataatcttgaatttaaattgtaatcaagcagtaacaaacttcatttaatatgcagacatctaattttataaaggaaattccaagttattgttcatttccatttattaatttatttattttgggacggagcctcactcactctgttgcccaggctggggtgcaatggcacaatctcacgtcactgtaatgtccatctcccgggttcaggtgattctcctgccccagcctcctgagtagctgtacaggcgtgcaccaccatgcccgactaatttttgtatttttagtagagattgggtttcaccgtgttggtcaggctggtcttgaactcctgacctcaagtgatctgcctgcctcagcctcccaaattgctgggattacaggcgtgcgccatcgcgcttggccaatttttgaagtttctttttttaatctgttgccatctctgagatgagaggtttttcattcatttggggaaaaaggaagaaaggtaatcaacatttattgagcacctactgtgtgccaaacagactgctaagcacttagtccttaagtaccctacgtgactgatgttcagagggccattttctctgtgtcaggaatcaggtgggagggccagaatccatagaacaaaaatataaccgttgcaatagataattaaaaagagggaccttttagttagtggcacccaaagcatcatagtgtgggctgtgagatctcagtaaaccagttgttggtaggttcccccaactcagagacctccatgagggttggatggctggattgcaacatggtgctaaaccacatctccctggttaagccatttcagttattgcctcatttaagttgcattgctgtaaaagacataggtatgacaagttgcaatgcctaaaattcgaacgaaagaatacaggctttgaatgttattcagagcttgactccggagtcccagatgcagtttcagggtgagtaaatacaaagccagcagctcccaagtttagatgagaaaacatttcaaagaaagccagcgaacgcttatatatttaacacaatatccatgactcattttctctttgctctctcagtccagccgttattcatttaccgctcaccccacaggaaagctccttttgaagtctgcctttggctactttgcaaaacatataaatatacaccttgggagaataagggtgagagagaaaaaaggcagaggtcataatttttaatcctggttctgccaataacaaactttgtgaccagatactttgtacagtaaaggaggatgtttttaaaacccattctcagttgccagagaggcaggcagtcatcattctgtaggaagacttgtttcaggatttctcagatgtctgctgtgtttggattgctgaggtccctaaagaaccttccctttgagtcagctcgactaggcttttggaagtagccctggaggtgtgatagcaccttaaaaattcttagtaactaggaataaatagaaggagaatgggaaggaatagaagctgggtgacggggaagggaatgccaagctgtcctgcagctgggatccacacttggtgaaggttgtgcctgcgtccctcatctgtggttgggtataccagaattttgatatctctctagttcgaataccagccttgacatttaccaccttggccaagtccctgaacctatctgtgcctcagtttcttcatctgaagagtggggattatagtcaatgtaaggactaagaaaatcaatatacgtaatacccctagtattcacacttcacctgctatgatgatattaccattctcctttggagttttctaacttatttgtgtagcatttagggcaaaataccaggcatatgggtgatggcgtgtagtggagttggtgagagggagaccttgagttgtagaaagggtgggcagaacctggtttctgtcctacatcccagatgttgcccatacatatcctgtttgtttctgaccaccctgctttgctgtgagggttcccagcccctctgcctttacctgtcctcattctgccccactgtccatgcccagcatgaatctccacttctccgggacggaaagttttccccagctgcttcagcccaaaccaacttccctccccactgccctgtgcgcacagcttatttgatcatgtcatttattgcttcattttgtggcttagatgtcttgcgtcccagtcagactccatgtgactggaggcctttgcctcctttcagctccagggtagtgtggcagaaagagcaaggagcagggagggaagggacctgctctcttctccagccctttctctgtgataaactcagcatgctccaggcgtttaatctctgtaatcctcacagcctcctcatgcaaaatgagggtctagaccaagtgacctctacagctgcccttgcagcttccccattttagagtagtagatggtgaataagtatggcccgaatgaatgaacaaatgtgcagtctcaagttggtcagttgtggcttaaattatttttgtgcccactggcatctcggcttggtaaatggaggaaacggtctctgacgaattttcactttcagtagacagaaattttgttaattttgatcattttatagtccgaatttgtggacacattgaattaatatttatattagtaatatgtctaagaagaaaagattttttatgctaacaaataatataaataatgtcacagactaataacagctaagagtcagtaataaaggaaatttgtttttaagcactttggaagttcctgtttgcatgcattatatgattatatatacataatttgtattacattattatataagctctcttagtctattcattaagtaatttgatgatcattttgaaatttttttataagtacttaagagagttaaaactatatttcttcttgaaacattgtaatttggacttgttttcttattcatattagatgtcttctctgagcccagttactgagtatgtagtaacttttttgtgtgttacaataattgacagagacggtggttcaaattttcagcatcaaacctcactttggaattatttatttccattttttctcttacctactagtatatatggatccaaaattaattgcttttttattatatttaatacatctatttgctttgtggttttactgatacttgaaaattgtaaacaattatgaaagattttgaactttaatcatcttaatttgcttaattaacataatttactagaggagagaaagagaaaacagacttggttacttatttatgtttgtaaccacctttgtatatgtagtaacaccagagcaggcacttcataattgaaaaggctttagggtaataagtcactgtctgtttcaaactgtgatgactttctggaaaaaatagcttttgtaatatttgtcatactggcccagatccagaaagtagtatgttcagtgtctaattgtactccatatggcctgaactcttgagcaatccatctgaagtaggaccctgttaagaaattattctttgtttttttttgagatgaagtttcgctcttgtcgcccaggctggagtgcaatggcatgatcttggctcactgcaacctccacctcccggcttcaagcgattcttctgcctcagcctcctgagtagagtagctgggattacaggcacccagctgttttttgtctttttagtagagatggagtttcaccgtgttggccaggctagtcttgaactcctgacctcaagtgatccacccgcctcggcctcccaaagtgctgggactataggtgtgagctaccgggcccggccaagaaattattctatgtcatacataattgggtgcaagaggtcttagtaatttgcattttaaaatgataattggtatcatctacgaagagaagttctaccttagtgttttagtttagcagtgacactaagatattatacatatgaaaatctcttaatgttagtgggcagaactgggaacccttccctttttttttttttttttgagacagagtcttgctctgccacccagactggagtgcagtgatgcaatcttgactcactgcagcctctgctcccccgggttccagcgattctcttgcctcagccacctgtgtagctgggattacaggcacacgccaccacgcccagctaatttttgtattttagtagagatggggttttgccatgttggccaggctggtcttgaactcctgacctcaggtgatccgcctgccttggcctcccaaagtgctgggattacaggcatgagccactgtgcccggctggaacccctccctcttacagttcacagggtataagaagctactttctagggcttcatcttaatatggtgattgagttctatattatggccaaaaggaaaattatgtgggtattgtggggaggaggagtcagagggctaggggcaaagcgggcagagaaatatcagctgcctttatttagcaaatatttaccagtcgttcctgcccatatgcacttgttccttgtgtacttggatctgaattgattaaaaaggtctgtatgtattgagtcttttcccttaggagcgcttaagctttcttttgatgctttttttctcttcctttaaaatggtgcaggaaaatgttggaataaacatagtcagcttgtgaaaggatgattctctcccttatctgggcataaatattgttgaatgtgagaatgtgggagtagctactgggccaaatatgcacaatgagtgcaagtgattattgaccttactgatgagaggaaggaagagaaatactttaaaactattttcacagggcatttcaaccaagatgtttttctaaattcggtttctgattcaaaaactggatttagctctttttcttgtttgtttcatctgaacaaatttaccctgaattgaatgggagagtgtttcttaatcccccatgtctttagcagtgagtcatttccatgttgttgagacattttctagcctttattgctgtgtgtagttcatgcttttctctggatgttttgactccttaaggaactcgcaataacaaattaacaatcacactcctctggaatgaaaacacgcagtatcggagtaataaatagcagttctcgaaacctaaataaacacagaaaactcagctctcgtacttaagaaggctctagaggagtccagtgtccaacattacaagcaagacacaccatttaaagccataggaagttaacatactttcattttaattttccaagggatcatgttataaaaccatatagccacttccattcttcaaaacttaataaacggttagttttagtcatctgacctgccttctctcaaatggatcataatttagtttaacaggtttgacattaaaataagttgtgtttctctgggaaactcatgttagcctggacttctccacttcctgtctttctctggtgaagctggtaatagtgactgagctcaggccatggcgggatcctcacagccctaagactaggtgccacctgtgtgctgcaacccagtaccaaaataacaggaaaaatctaaagttatccagataaaatatgtcaaattataaagcctctgagtcatgacagtaatcaaacctgattctatatcagcaatcaaacctgactctatatcagctttaccaaacactattaatatatcctataataaaaattaaggcgtcattcctcaggttctttagcaagtaagtcagtgcatctatctaatttgctaaggctgaaacctattgtacatagaactcgggtctgaatggttgtcccgtagaaagttttagagcagagcaaggttgtaaatagccagctccagtggctgtttttcaccctgttcatgggttgcttgccctggttgtatatttagttgcctgtgatggatggagtgaagtgcacaggtcgtctctcaggggtgaacactgggtttgattagaggccattgtcatgaaagatactccagctcttccatgaccatacatgcttagaagaaaactttgatgcacaaagaactgaaagccctaggcactggaattcctgctcatcaaaaagacacctaaaaaattcttttggagacttcatgaattttctctcgattcatactgaaggactggtgccagtaatatttttcctctttgcctgtttcagtttctcatgaagtttttccatatttagacacactgcccagttaaagggaatgccagtcactcggggtttaagacaatgaagtatgtacttccctcaccaatcagttgggagagctgattgggctgaacttccagtctgaggcatgtgagtcacacacaggcagagatttaaatgttattaacatgagaaagatcttttgaacgtgaagtcatcatgcttgaggttactttgaactttcctcatagtctcttttatgatttgtgtaagaatcaacatgctttagtcttatgttaaaaaaacacagtcgagtgaaaatggacatgaatttaaaattgcatgatagccagaaacttttcatactgtggaaatgttacactgtgataaacatttagtgaagctgcttggctcatgggctatttttttaatggcttttgggttcagaaatttcaaaatgtcagattctttgtaatttaaatttccttctaagtaaggaagtgcactatgttattaattttaaaaatatatatacttagaagttgaaattgtgtaattatcttaatgctccagagtctcttttctgactaaacattggaacttattctgttgaatgcagggaatttgtccagaaaagcttaaggaaatttagcctacgaggggaaatgcgctagattcataaataaaaggtttatccaaaggggtgatatagaacatgattttatctataaaagattgtacttgagttttgtctcttcctcctccttttaggattaagtaatgattgtagcttagtttttatagttgatttatagtaataagttatgtgtaagctgactgtgggtagttgaactcatttcaactgcagaaggatagattgttgtttaaaggatcatacaaaaattattattttttaataaaatgaaaatgtccccagagatgttacacctggaaacttaaaagtaggaaaaatgataatatagtatgttactctatctctggaaggaatgatctctcccactgaaaagtaaatagtccaaagtttacaatgtttagttgaaatagcttataaatcacggcagtgacttttaatccttagtagaattctcctttatttctgagaagtctgtataaatgtttatggaaacacagtctgaaatattttaaatgtagcataccaatagtacttaaagagaactttacgcatgatcacacacattcagagttgttgggtaaaaacaccttgtaccttctttggtagaaaatacttctgtatttgcgtgtgtgtgagagagagtgtgtgtgtgttttaaattcttaaacataacagatcttttgaagcagagcagaaaactcgcatgttactgacactgcattctcagccatggggaaagcaacagtgtgtttcagctttagcaaattacatgtgttgactcactaaagaacctgagtaactacacctcagtttttattacaggaaatattaatagtgttttgtaaagccaatagagactcaggtttgattactatcatgactcagagactttataatttgacatattttctctggataattgtagatgtttcctgttattttggattttttattatcgttatttactgtgagttttgcgctcatatacatgtagcccagaaaagcgatagtgagatggttcagtgtatggaatcagttttattgaacaaacagtggggcaggtggggggagatacttttttgtaattagactattattagtgagcacttcctttggcttttgttcatttaaatgtatcttttctttataacttcacaggacgtggaacatgtaaatgcattttgagttgaaagcagaaaatcacatttcagtaaaattaaaagctcaagatttcattttcttgtaaaatttctaatcatccccatttgctgaactttgggccctttcttggcattgggaggtcatggctaatgaatgcatctcctgttgcctggcttacagccgccccctgctgcagtgccatttgggagaagtgtgtaatgtgcgtgcttggactcgttatctcctttcatttcctcaacatcagttaatgctgcatagtttgcaacatgatattgctttgagttggtgcctaattgtgtaggctggctagaagaacgaatctttgcagtggtcaggtgaggccactgagtgtgcccctttgcggccactgcaataaggtggttgggaattcttcatttctgatcactgaacttttccagaacgtcccaaggctcccccaggaactgtattacagcatgacattctgtgtatgtgggtttttctgggagaggattgtagctttcaatcagatcctccaagaattctgtttctcaaaaggttcataggaaccatttatttagaattgaaagataggcacatcttctgaggaaaacaaatgaaaggcttaacaaaatgttaaggctgagttacagaaaacaagccataagctacctattttattcaattaaaaataaccatgacatggccattttgtaaattattacattaaatctgcattgcagacatacctggtacgtatttatttatttattttttaagaggcagggtctccctctatcaccctggctggagtgcagtggcatgatcatagctcactgcagcctcaaatacccgggctcaagcagtcctcttgttccagcctcccgaatatctagaactacaaggacgtgccaccatagctggctcattttcaaattttttgtagagacgaggtctcactatgttgcccaggctggtctcgaactccctggcctcaagcagtcctcccacctcagcctcccaaagtgctgggattataggcatgaacaaccacccccagccacttggtacatatttcaaatgtggtttgtttcttttgaaataatgaaaaggaataatgtttcagggtttgtggcatccacattttgggatggctacatgccgtaaccttgttcgtagtagctcctgatttttatctgtattagaaattgctcggcatgagacaaatgaggaacatttggggaaatgtgtgagtaattgagtaaaaactaatagctgtcttaagggaaccatcttctggtttgcatttgtattaataggtatgcagagcaggaataatttggaacgggggagctggttatcctctgggtgtgtcaagcacaaatctcagattccattacatctgcacaagtcttgacagtttgcaaaatgtgcctagaggtatgcttgataaggacagacatttcttgcctgggttctaactgtgtcactgctagcacagtatctggcctgaacagcatctaaagaaatattttgctggatgggttacctcaatgggttctcatagcagccctgtggatatagacacagcatgttttatcattcttttctacaggctcaaagagggtaattacttactcaggctcacatagctggtaggaaaaggatttaggcctctcctttataccatgctttagctcgacccaaataataaaagcaaaaaagccatgtttggatcaactgagttttaatagaagagcattggagagaggttgtaaaccctcagatattttcaaaaataatagtaagcattcttgacttgcaatgcagagaatgtcttaagctcatatgtcttgatggtgctaatcaagtcaggcttttataattgagtgaaagcacagaaaaataatttattcattcttatacaaccaagtatttattgaatgtcttttctgcaccagacatggttgtatgcactgaggacgtaacagagaacaaacaaggttgtctaagtccctgccctcagagagcttatgttctcatagtggagacaaccacaagtaaattgcataagtagactctatttgcagaccccccaaaatagagtaggatatgttaggagaaagagtgatggcaggggcgaaggggattcttttgtttggtggagtcagggaaagtcttaggggatgggcttttgtacagagactgcagtaaggtataggagccagccctggaagatgggagtggtgaagggtgagatgagaatctgaggatgagcactgtaaaggaagagaatggccaggtgaaggctctgaggccagaaggagcctttgaattgatctagaggctgcaggagcttggattttacgctaaatgtgatgggaaactctgttagttttccagggctgctctaataaattaccagaaacttggtgggttaaaacaacaggaatttgttctctcaaagttctggagggcagacgtctgaaatcaggtgtcagccgggccacactccctcccgaagctctgttgggagaacctttccttgccgctgtcatcctctggtggttccaggcgttccttggcttgtggcagcgtcactccagtctctgcctctgttttcacatggccttctcctctgtgtctgtaccaggtcctctcctgtctcttagaagaacagtggtcattggatttaggacccacccgggaaatccatgacatttatgtcaggggctggaaaaggaaggacaggtgggatgtgaccatccggagagcctatctcagctgtcatgggttgtcacaaaggccattgtgtggttaatttttatcttcttattcttgtttcctctttaatctttcattctaagccctatagccctgactggcagattcgctgtcgggtttttctagttgtagatgacatgctttttcttaaagccatcttcatttattaatctacattcgtttttaattttaatgcaccaatcaataattatttcacttgacagtttttgacagcatgctgcttgcgacatttagctgtttagcatgaattcaaaaggtgatctatcaatttgcacaaatgaaataaagttgctctttcttcctgtgctttgggggaatgtataaaaaaatgtatgtttatccttccctggagaatttttgatgtagaaatactgaatagttttctatataagaagacagaggactaaagagctttaaaatttgttgtgcttattttgcttgtatcataaattcacgtgaaaggccagatttctcttaattgcgttgatattgtggagatgaatcattcaacaaatgtttattaagtgctcattgtgtgcatggcactctgcaaatgttatgggaaataaagacagagtccccgggaaataaagacagagtccccaggaagtctagtagtcagagaaacaaagccacttcccaaattatggtgggtagaaaaacttaggaaatgacagttttatcatgctacataccttcacttaatgaatcctatgtgaaaattcccagtaaaaacctatgaacaaaagtgtgtggttgtcttcatgtatacattgtgtgcacacatctgtgcgtacaatgcacagctttgtatgaagctagctgaaaactaaacagctaggctgaacttagctgaaaactaaacagcaggggaaatgttctttctcactaaaatcacagtgttaaaactcttggcagttcagatggtctccactgtagctgttggtttacattttgataatttaccaaagagcataatatatttaattcctagttggatggtgtaactcaacacagcatttccagcgaaacgctttgcaaatgggaagtaagcattttctttggaaaccagcagcttccttactcccttggttcttctgtgggtataagcatgacctataggttagaagttctggaacagaaggagaaaaatgaattatgtcacagttaacaggaaaggaggtgctttgcattcttgctccgttgcagttagttttgttttccttccttggtttgggggcatttggccttgcatatcctggcaagatttaggcaaaacaggcactgaccttctttctggaatgctctttcattttgccccatgcatattattaagaggcataattcactgtcatatttttgtggctaaaagttttctaacttctatacactgagcctttgttttctgcttaatagggcaaaagagctggcattttctgggcatcattgacccttcactatgatttagattttttaaagaaacacataaactgttcattgcaccttgttgtgtggcaactctgccagtcactaattggtactgtggatatttggctgttgctcttatttactttcctctggtttttacatcacttaattaaatcttgtgccagtttccattctatacatgtatagggaagcaaacagaaactttgtcctgaagcaccaggttctttggcttcatcatcctaaacagctctgtgaaaatcagttgaaagtgagtagagccagaagtggcgtgtaagccatgctgtcagcgagggctggctggatctgcatacgatcgccgccttctgcccctgcttttggagactagagatggcttctggtctgtgtccagggcttgccatgctgattcagagagctatgccacagatgagcctgagttgagaccatgatgccagcatatcctcagacccacgagatcgttatgccagaatgttaatccgcagtggaaaccattactaacatactctcaaggcccacatgatgagcacattctctctctgtgttaagctgcatgggaatgtaaatcctaactggaagctactttattgatgtgccttgagaaattgctgctctctggctgcaggtatcagcagcagtcacagtgcacatgctctctaaggaagatccatatggagtcaggtgtttgcttggtgagcagggaatcggaacaagggagtgggatgagttgactgttaagtggcaccaagcaaacatagcctgcctctctgttcatctcaggagaagggtggcttttctagtgggaccaggaacatgtcagtcattgcctgctactccctacagtcatctcactagggtggccttgcctgtgaagacactgtattctccccaacaaccttggcattgcctacatagactttagtgactctgtactttcctggctaagccagccctggcgcccttttgaggacacagtcttttcttaaattcatgactatatttcatcaggtgctggctggggcaggggtagtggtgatggtagtaattatctttcttcagttggctttgtatgtccatgttctcatccactaaattttgttcttactataaaccgctaactaggcaatctcttccccgttgtcaagttcttggttggggaatggtaatctttattgtccttcttataagtccctttggaatggatagaggctttgggatggacatctcgtgaactgtatcttcatatcaagctctgtgaactgaatggcaacaaggaggcattcatccagaccaggagtaggcaaactatggtccatgggccaaatccagcctgttcttgtaaataaagttttattagcacatagctacatccaataatttgtctaatgtctatagcagtttttgcactacactggcagaatttgatttgagtcatggtgaaagagaccatagtccaagaaagcctgaaatatctactatctgatcctcatcagaaaatgtttgccaactgtagtctatacctttgcacgtcagagaattgcatcagggaagaactagaagccctccttttgcacccccacaaccctgccacaattcagtgaacaaacagaagatcagagagggaatgtgacttgaccaaagtcacacagctggttcataggaaagccaggacctgagctcagatcttccagttcctagtgtatttgtcttctacttttggaggacgttgtgagttttctggtttacagatgattaaccattacaacatactgaaagaaagcttctttagtggtcagagctattttccaaactgacttccccaggcaaaatcactagccagcttggcattgatactcatttattaatcttacaaacagtacctaccatatttcagggatggggctggggctaagacactgatgaagaagcacaatccctgcccttgggaagtttggatgagaagagtggtcagatagctagatacagagatgcatgtcattttatctgtagtgtgttacttatcatcataggactgtgatcatatggacgaaggatgcgttaatttagccttgagtgggtgggggtgttgtcaggaatggctccatagggttggagatgtttgagctctgtctcaaaggagattgagttcttcaggtagagaattgcagcagaaatggctgtggtcctctaggcttgagtgtgcatggtatccagtaatttgggaatgcttgtctaacacaactagaggtagggcttaggggacgtggtatggggttacaggaaatctagttggaaaagtaagttggagccaaactgggaaacttacggcatttcaaatgctaaggagtatggactttggcttatattctaggggttttctaatctgtagattccaaaacatatgggagaccacatttcttgtaaaagaggacctgcacattcataccaacacaaagcatggtctgtagatttggtcatcagaatcactaacagaaataggagctttcttccaaatatatgtagctggctgatattgtaagtcattagccagaattcattcacagcgttactaagttcatagtatctttttgaccattgtacatcttcttgatcaacagatattaagagttaaacatctagtgcctgaagtctgcaacatttttgattgaagaaaatgttgggaaccactgccgttgatggcagtagtcatgaaattttttgaattaacacatgttataggttccagagtcagctgccctaaattttactagctttgtgactttgagcaagttatttaacatacctcagctgtaagagtctttatctctaacgttaaaataatagcctctgtctcttaagattgttataaagatatgataatgtctgaacgcatgtagcatggggccaggctgatgggatatactcatgtttaaatagaagctattgtaatgatttttagcggatgtggcatatgcagatgtattttagatttgacccagtgtggacgatgagttcaaaagggagagttgtacgaccttcctgttatccaagtgagaaataatggggccagggtgggcaggggataggttagggaaggagaggggagagggagtatgggaaggtgtatgtccactttaggtaatgaagtgagaaatgaaagaagccacattctgtttcatgcccaaagcaacagacaaggcacaaattagagtgtagggaagccagtttctgtgacttgatggcatagaatggtgtggcttatctggcaaattccacgccccgtaactcctggaattgatctggataagaattcaccttgagtaaattttaaaaattaatttaataaattaatagccccccctttgaaacacagaaaaattagaattacagcatgagtatctttttttgctctaaaacagtacagcccagcagttcagcctacacccatcacagagctttcaaaggaatgtatacaagaaaatacatatacaattacaaattttaaaaattaagtaacatgtatatactgttaaatatttatatattgatgcttagaaaaagatgggacaaatgttaagtgtcagctgggaggtttttactttcttctttgccatttctgtatttttcaaaatgaatatgtatataattttaaaatgtgttaacactatttcaaaaggaaaacaatcacaaaaaggaatagattggaaaagcttcaggggacttgctatccttgtctttttgggtagctgttctacaaaggcgggtggtggtgggtgcctcccagctgtgtctcatttcagtcagcggatgctctgctaaatctagtgatgggcggcctacctccgaaaggtgggtgggagtgagggatgagtgtagcagtagtacatgcaaatggggccaggttttggtgtgtgtgtgtgtgtgtgtgtgtgtgtgtgtgtgtgtgtgtgtggtgtgtggttttttttttctttctttttttctacagtcttactctgtcgcccaggctggcatggagtggtgtgatcttggctcactgcaacctccgcctcctgggttcaagtgattctctgcctcaacctcccaagtagctgggactagaggtgcacaccaccacgcctggctaatttttgtatttttataaagacgagatttcacatgttggccaggctggtctcaaacttctggcctcatgtgatccacccgctttggcctcccaaagtactgggattataggcatgagttactacgcgcggccagggaccagttaagatttgacgattacattttattgaatgtttgcatcagaggcacctggaaggcttgtttagaccacagatttctgggcgccaggcccaggggttctgatttaatagttctagggtggagcctgagaatatgtatttctgacaaatccctccgtgaaactgatgctgctggccccaggaccacactttaagtgaggggtagtaagcgggtggagaactgcatggaggatgaaaagcatccagttggattttatatttgctcccccttcttcatatacacacactgaaatcactccactctatgttttctcagattctttccctgtctggaatatttggttctctcttcatgttcagtcagtagaaacaagaagtaactcttggattgagcagttttcacacaagtagcccaaatgatattgacacatcatttctacacagcatcagcttgttcacacacatacgcccccagaggccaatggcgtcctttggctttgttctcctttttaaaaattcagtgagtaagctaattttataggaatgtctcagaaagctattcctgtaaacccagcgtttgtaaattgaaatagaggaagcggtgctgattaccgcaattgtattgaaacttattcatggagcggtccctctagattcagatagtttggacagaaaccctccaactcttcccttaccactccattgtttggtaaagtttaatgtgctcacatggcatctactttttcagccagggttaatactcctagcgattctttcactggaagggatgactcagagaggaagagttggcattaattgcttcatcaactatgcttattatgagtcatctcttgcttgtcttagtaattcagctggaaaaaggagaaatgttatctctggttcctgaggccagcttgggcttcagtgaactaggatactccctcgtagccatttgtgagtttcattcagttactaagggaatgaacagattgtgaatctcattatcctagcaggtacatataaatctataaatggcgaatggcagttacttcctgatgtttatcagtgatgagatgccacaggcaggacgttagccctagaaaggcactgttttgaaggtggctgattaaggggcaaaagaaaaaaaaaaaaagcaaaaacggagggatatgttcaggtccctgcctttactcagttccctcccctagcttccaatttgattaacagaggtgtcgagggaggaagagaacaatttccaaataaaactgcctttggttctttttttgagtgtaatgtggtaactggattatttggaaacacgaatttaggtctcttactttctacttcttgcgttcagttcactcgtgtcttcctgtttggtgtataccttccccttctgactcagtcttctctatttctcttctcactgtagcagaccaccgttcttcccctgccttaggcgtttctcacttgctgtctgccttgcgtggctgttttcactcaagcatgttcactgttcctttgtacggaataggggttatccccacagaccctccaggtagaaagtacatctttcttttcactaataaattagtttattattaatagtgaaaagaaagtacatctttcttttcactaataaattagtttctatttagggagaacatacagtgaaatcaacacatcttaagcgtacagcgcaatgagttttgatgaatgcatacatccacataatcagcatcctaatcaagatatgggacatttccatcaccccagagcccctctgcccccttcctgtcaactttccacctccccgtcatcaaccactgctttgatttctgtcactgtaattgaattttgtttgttcttgagcttcatacaaatggaatcagtcagtactttttcgtatctgctttcttttgttcagcatatcatttttgagatcatctgtattgttgcaggtagcaacagttaatttaaaaaatgctagccagaggccaaggcaggcatattgcttgagtctagaagttcgagatcagcctgggcaacatggtgaaaccctgtctctattaaaaatacaaaaactaggcggcagcagtggcacgcacctgtaatcccagatactcaggaggctgaggtgggaggatcacttgagcctgggaggggtcaagcctgcagtgagtcatgatggtgccactgcacttccagcctgggcaacagaatgatgtgtcgcaaaacaaacaatctatatctatatagatatagatggtttttttttttattttgtgaacttacatatatgtgtgtatatatatatgtgtatatatatgtgtatatatatgagttctttatatagtctggatttaagtcatttatcagaaatatgaattttttctcagtgtttggcttacctttttcattttttaaactgtgtttgatgagcccctttaaattttaatgaagtctaatttatcattttttaagatatatgctttttgtgtctttataacatttttgcttaccctgtggttgctaagatgttatcctcctgttttctcctggaagatttctagtttagccttaacatttaagtatatgagccatttcaaattaagatatgaggtgtaggggtcaagattcagtttttattaaaatgtatgaaacaacaattattgaagtgattttttttccttatgaaattgccatcacacctttgtcaaaaatcatttggttttatatgtgttttaagactctctgttccactgatctgcagtctgtacttaggtcaatactatattgtcttgattaaaatactgtcatgggctgggctctatggctcttgcctgtaatcccagcaccttgggaggctgaggtgggaggatcgcttgggcccaggagtttgaggctacagtgactgcagcattgcattccatcctgggcagcagagtgagaccgtgtctctattaaaaataataataataggctgggtgtggtggctcatgcctgtaatcccagtactttgggaggccgaggcagaaagattgcttgagctcaggagtttgagaccagcctgggcagcatagcaaaaccccatctctactaaaaatacaaaaatcagctgggtgaggtggcatgtgcctgtagtcccatctactggtgaggctgaggtgggaggatcgcttgagcccaggaggttgaggctacagtgagctgtgatcatgccactgcactccggcctgggtgactgagctggaccctgtctcaaaaataataacaataaaattcaaaaataatgaataaatgttaaaattaaaaactaaatagctttatggtaaatcttgaaaacagatagcgtgagtcctctctgtcttgttttttccctcaagattattttggtggtgttctatctccttcagagttccatataaatccccctaccccccaaaaaagcctgttagaagttagttcagattgcactgaatcataagagagaaatttaaggaaaattcaccttaacaatattgaaacttcaattcaaaaacacggtatatctttctctgcctttttaatgaatttctgccaggaatgtttccctgtttttcctgcagagacattgcatatctttggtaaaatttaattgtactttatgcttttcgatataatacatgtaatttttaaatcatccttttcaaattatttatataaccaggactttttttctgatcgtacagggaaagtattaactatttcaccactatttcatcatgatgttagctgtaggtttttcatttgccttttattggattgacgaagtttccttctattctcttttttctaagaatttgtgtttgtttgtttttatcgggaatgtgtgttgaattttgtgcagttcatttttgcctctgttgagatgtcatatggttttccgctttatgtggtgaattatattgattggttttaagtgttaaaccaaacttgagttcctgggataagaaccagttataattatgtgttattttgacctattgctggatattttggctaacattttattaagtatttttgcgactatgtttattaagaacattggtctgtaattttgtttctttatataatatttactagggtttagtgttagtgttagtaatactgattatataaaatgtattcgtggagtcctcctgttttttactattttctgaaagaatttatgtaagattttctttcctcttaaaattgatgaaattccacagtgaaatctttgggcttggagttctctttgtgtgaaggttctaagtttttaaaatttaatttaaaaacattataaagtaaaatattcccttttttgatgtacaattctatgcattttaacatgtgtagagttgcataactaccaccacaatcaggatacagaacagttgtatcatcattgtgccaaggattttgatactgaattcaatttcttaacatatagccaactcttcagattttctgtttattcttgctattggtaagttatgctttctatttttcaagaagttttttatttcatccaagttgtgagatttattgacataaagtttttagtaatactttcttcttatctatttagtgtctgtaggatttatagtgatatccccttttccatttttaatgatgttttcatttacttatttttgtgattagttttgctagatgttaattaattttattaagctcttcaaagaatgaactactgtttgctttctgttcttctcattatttccttctttttccctactttggatttaattttccttcctccttcctttctctttttcttttcttttctttttttttttttgagacagagtttcgctctttcacccaggctggagttcagtggcacaatcttggctcactgcaaactctgttccctgggttcaagtgattctcctgcctcagcctcccaagtagctgggattacaggcatgcaccaccgtgcccagctaatttttgtatttttagtagagacagggtttcgccacgttggccaggctggtcttgaactcctgacctcaggtgttccacctgccttggcctcccaaagtgctaggattataggcatgagacaccgtgcctggcttgctttcctttctctatatcactgatttgaacgtcttctttttttttctgttcctaggtacacacacttttaagattgatgtatcttcctaataagtacaccctttaattattatgaaatgaccctttaactctggcaattctccttgtctagaaatctactgatctgaatatggctacaagagctgcaggctgttcagacttcagccgaggtcttgcaatgagcccttatgttttaattgcattgtacaaattttgatatatacttttattgtcacttaactcagtattttgtatttccattttatttcctctgggaattgtctagtagtaaacattttaattcacagacgtggggaatttttaagcttcccttttttccttaattgctaattacatttttatttatttatttctcttcatagttgttgctttaaatatctctgtgccattttgttagatgcatgtatgttgacgattataaaatcatctttattggttgttccttttgccagcctaggatgtccctcaccatcatttataatgcttttaaccttacattccattttgtctgatattcagagtgctatcctggtttttgtttttagttttgcttatattttcttttttaaaaatcttttagttttaatgtcattgtatatgttcattttacacgcatcattcttcccccccaccacatattgtgcatagctctgtacttgtctctgttatttgattagtgactttatacccagttatccttactgtaatcatttttattaagatttttagcttcatttaatgttttctacttggctttactttttgttttgttttgttttgctttcttcctttggatagatcggattttttttcccgaacacattttattttattcttgtagcatttatacctttatttaaacataaacttaggtataaacatagtttcctttatgtctaaaaattatcagtaatttttaagttccccaaatgactcccccactcataaccattggacctcttctctctcagtctgctattttccccagtgttccctctactgagacttaaccaccttctttcctgcaagaattccccatcacatggaaaataactctcagctgcatcaacctctagcctgtgcaacttccccaccttgcttggaaccggaaatgacttctacttttagaaagttcattctctgggcagagtagaagatagaattcattggggtgttattgagacagagagaccatctaggtactcttgaagaagtccaggagactttaggagggtccaggttagagtagtggcagtagagtgggaggactggtggaacaaccgggaggatttggtgttgtatttgaggagtttgagaaaaagagaagttgatggtgccaagtatgagtggcaaatatcagatttcttttattttttcctaccctattctcttccctcccaaattccatttgcatgacttcttaccaaggtttggttctgccattttaaatgaaataagacatgtaaaacacatggtatatgtcctagtatagaaatagtaattaaaaaaaatagatgctagcttccacatttctgtctcaagtgctgactgtatgaatggggaggaggagcctacagattcctgaggaggaacaacttctttttcttggtggcagggtggttagaaatgtaattatttcatttcttcatcttttgaatttgagctgccaatgagacatttaggtgacagaaaattgtatatctaagtctaggattgaaaagagatgatagagattcaatagctgttaggaaaactgtagaagctcgtctagcgggaggtgataaagtgaagagaagagaaatttgaaaagcatttatgggatggattggaagaaggaggatccatcagagaaagttaggaggcctgaattcttgtcccagtctggtttatttagccctgaataaagcacttaaccctctcagggtcctctttctttcttcctttttttttttttttttgagatggagtcttgctctgtcgcccaggctggagcgcaatggtgcaatctcggctccctgcaacttccgcctctgggttcaagcaattctcctgcctcagtctcctgagtagctaggattacaagtgtgcactaccacgcacggaccatttttttgtgtttttagtagagacagggtttcaccttgttggtcaggatggtcttgaactcctgacctcgtgatccacttgcctcggcctcccaaagtgctgggattacaggcataagccactgtgcccggccctctcttcctttaagatctctttctttctctctgcctctcgttctctttctccattcttcattaattcaacaaagatttcttgcatacgtattgggcgccaaattctgctctaggtattgaggctaaagcataagataggatgtggtctttgacctctagtactgggagcaggcaacagattaatcattgctctctgttaagcattatggtagggtatgtttcatacctgagtcaggttgactggaggaaagggtgctgagaaggcctgcagagcacgtccttcagtccaagcttttcagaatgaggagttgttcagacaagcttgggcaaagaaagacaaaagaagtgcaaaatagtattatatggatgggctgaaggagcaataagcagtttggtaggtccatagtgaggcaggcctgacaccgctagaggggctcagggtctcgatcaggaagggcccttgtgagccaagcagagatcttggattttatcttggatgcaatgtagacccattcaaggactgtagggatgtgaaaagtcaggtgtgtgtttcagtgatttcattctgttagtgctatgcatttggcatgataagggaccaggtggtgggcaaggagaccagagaggaagcagttgtagaaatccaggtgacagaggaatgttgaaaattccagaaccacagagcacctgcttcatgctaatcacaggtctgtgtgctgcggcttctgcagggaccaggacagacaggccccttgttctcatggagtttggagtggcaatggaagtgacagaatggaaagaatgagcagattggagagatgttaataagcaaggatttagaggacttgatgagcaattagatattggaagtgaatgagaggggggtagtgtctggtttgaggaagtgaatgggcaaatgacaccactcactgtgattggggaaccaagagaataactgagtgggaccttcagggaaaggtgcccagcctgcacttgtataaataggtctggatctcaggaacggcctccgtgacttactggatcagggaaagaattggactatgtggatgtttacgttacttgattttattctgctccatcattcagtttgggtctgtgactgttgagtcacctcacagaggacgaggtatccttatatctctttccctaaaacctagtgtggggtgagcaaaacagtagggctattgtttgaagtaggtctggaattctgtatcattaatttctttgctcaccctctgatccctgccttcactttagccctcccccaagtcccagcataggctcactacctggattttggcttctgtgtgaactgctgtgggcaatcgtgtcatattcctgtcacagagactctaggatgctccagcgggtagggattttaggatcactgggtccaatctctgcaattacagatgagagaggtgaggcctgaggaggcaagggggcctgcagagcactggtgtagggctacagtgtggtcgcttgattcactggtctgttttgcactgtgccccctccccctcgctgagtgcttagagagcagggcaggaaaagttctgcacattggtgcagacgtttggaaatgactaagcctgtgtgtgtaactttgagacttctcgtgaaggttgtcaagaagcatttgatcacttcagctctgaggtagggagacagtctccttgggcatcacacttgcattccagcagcccccttgtttggggtgctctccaaaggctccccgtaaggaattgtttcaccccgggtgtagaatcacattgcactgcggcttcaaaggaaaagtaaaaaagtgcagaaattaccgaccggagtgtgggaagtacttcttgttggtaagattttcaagtgctggggaagagatgtgttgaaaggacatttactttcatcagcttagagcatctgttttttatactttaaaaagaagcaacacctcaaattatggcagtccctgggcaagtaagcacttgagattttgatctgtacagattcttagagggagcgcctcgcaggagctgttagtagtgatttgtagcacttaactgattctgtagaccgacagtcaatcttggggggaaagggggttcagaggcaatgatagttaaggaactgctccgtaaaacagcaaataagccattgctcttgcacccgagtagaaatggaaactgtacttagcaggctctggagaccaaattagataggaaatgaaaataaattccatgttttttatttttaactcagtgcgcacctccaaaacattcgtacagtgtgggctccatgacgtgttttgcctgctctcttatacagatttaagtttttaaatggtagttagagacactcaacataaaagctgctgctttaaccgttgttgttattgctttgtttttttgagatggaatctcgctcttgttgcctgcactggagtgcagtggtgtgatctcagctcactgcaacctccaccccccaggttcaagcaattctcctggctcaggctcccgggtagctgggattacaggcgtgcgccatcacacccagctagttttgtatttttagtagagacggggtttcactatgttggccagattggtctcgaactcctgacctcaggtgatccacccgcctcggcctcccaaagtgccgggattacagtcgtgagccactgtgcccaacccactttaaccatttttaaatatgcatttcagtggcattaagtacattcaccatagatgtactatttattataggcacagtttcctaaactgagtaaagaaaggaaacatttacccccacagcccagtatagtcattgttaaaattaagatgttagtctccaagtcttttgtttacatgattttgttcaaacctagttgcaatacttttcatagaggttataaagagaaatatagagttataaaggaatttttttaaaattatactttaagttttagggtagatgtgcacaacttgcaggtttgttacatatgtatacatgtgccatgttgttgtactgcacccattaaatcgtcatttacattaggtatatctcctaatgctatccctcccccttccccccaccccacaacaggccctggggtgtggtgttccccttcctgtgcccaagtgttctcattgttcaattcccacctatgagtgagaacatgcggtgtttggttttttgtccttgcgatagtttgctgagaatgatggtttccagcttcatccatgtccctacaaaggacatgaactcatcattttttatggctgcatagtattccctggtgtgtatgtgccacattttcttaatgcagtttatcattgttggacatttgggttggttccaagtctttgctattgtgaatagtgccgcaataaacatacgtgtgcatgtgtctttatagcagcatgatttatactccttttggtatatacccagtaatgggatggctgggtcaaatggtatttctagttctagatccctgaggaatcgccacactgacttccacaatggttgaactagtttacagtcccacaaacagtgtaaaaatgttcctatgtctccacatcctctccagcacctgttgtttcctgactttttaatgattgccattctaactggtgtgagatggtatgtcattgtggttttgatttgcatttctctgatggccagtgatgatgagcattttttgtcttttggctgcataaatgtcttcttttgagaagtgtctattcatatccttcgcccactttttgatggggttgtttgtttttttcttgtaaatttgtttgagttctttgtagattctggatattagccctttgtccgatgagtagattgcaaaaattttctcccattctgtaggttgcctgttcactccgatggtagtttctttggctgtgcagaagctctttagtttaattagatcccatttgacaattttggcttttgttgccattgcttttggtgttttagacatgaagtcgttgcccatgcctatgtcctgaatggtattgcctaggttttcttctagggtttttatggttttaggtctaacatttaagtctttaatccatcttgaattaatttttgtataaggtgtaaggaaggggttcagtttcggctttctacatatggctagccagttttcccagcaccatttattaaatagggaatcctttccccatttcttgtttttgtcaggtttgtcaaagatcggatagttgtagatgtgtggcattatttctgagggctctgttctgttccattggtctatatctctgttttggtaccagtaccatgctgttttgattactgtagccttgtagtatagtttgaagtcaggtagtgtgatgcctccagctttgttcttttggcttaggattgacttggcaatgtgggctcttttttggttccatatgaactttaaagtagttttttccaattctgtgaagaaagtcattggtagcttgatggggatggcattgaatctataaattaccttgggcagtatggccattttgacgatattgcttcttcctttccatgagcatggaatgttcttccatttgtttgtatcctcttttatttcgttgagcagtggtttgtagttctccttgaaggggttcttcacatcccttgtaagttggattcctaggtattttattctctttgaagcagttgtgaataggaggtcactcatgatttggctctctgtttgtctgttagtggtgtataagaatgcttgtgatttttgcacattgattttgtatcctcagactttgctgacgttgcttatcagcttaaggagatttgggctgagacaatggggttttctagatatatgatcatgtcatctgcaaacagggacaatttgacttcctcttttcctaattgaatactctttatttccttctcctgcctgattgccctggccagaacttccaacactatgttgaataggagtggtgagagagggcatccctgtcttgtgtgtaaaggaatttaaagacagcctactccttctccccttctctgccccgtttatagatgaagaagtgaatggccaaaagggttaatggcttgcttagctggacagtggccatgcttgtcccagagcataggtgctccatcgcctgagcgccattccctgggctagtctgttgttagtttcaacatgtgtcataaaaaattcattggtggtttatttttagggtaatcttcttttttcctctgtctctttctttgtgtagtttctgtatctaaacttttttaatggcatcttcaaataggaacttgttttaaaccagaacgtcacaacacgtatgccattcctagggtttatcaccctgatgccaacatcccctcccaaacctcgcttctgttcagatattaccatacccaggaggtcgctgctttttgttttttttttttccatttgttttgctggttcacggttcattccagagtttaaaggtgctaaaaccaaagtttaaaggtgatagtaattgtcccatgttgggtttttagctggtttctttttcttcttaagatctgttttccacttagaaatgaggtgaaaactcacagaagcaaagcctagcagctaaaagcagcacgtctgcttaccacgttacaccctccgggctgatctgcagcccagatcccctttccatcctctacctagctcctcaattcccatcggtgagcagttttcacctcctcctgcccacgtttggaggtctgtgggtggcggttaggaagccaaaggaggctgaagctggggtatattgtttgggtcggccatggcaaccgcggcaggaaaaggaacaggactagttttgtgctgctctgtaaatggccaggattcagcagctatctcaggacttctgcttggccccagacaatctgatctcctggtaaggttattaaacttggctctcctcttccaccctcctttgatcatgttgtcaggcagcgagtaggaatggccgtaaggggtcggctggtgggggttgcagagcacagcaagatatgcaccagcagaaacataagaacaggggcagaggcaaatcagggactgtgttcttatcttttctgcaccccagatgcagagaagtacatccccaagtccttgccaatactattcttcaagagttgagcaccttgctccaaagagcctgtccagatcgccagtttgaccagcatggaggagaacaaggaagggccggtcctggaagaccccaggatttttttaattgggaaagcattatttgagttttctctgctgcaaagcacaaactgcctaccacatgtgtttcataaaaatgtcactgaaaaggagagtgagaatacagagtaagcttccatggcttaataatagtttattttgtgacttggaatagcttttcttttcattcagcggatcattttaggtgtcattcagtttattttaagtagtgtgtttcatcctgagcggattaagaattttattttttaaaactctgtactgtgttgcttcctactgggaaatttacattaaaaaaatgttcgtgagcaaaatctatttggtcaaaaagaatggcccacgattatcactgaatttgggatgtttttcttctaagggacacagttgattcttactcagaatcatgcgagtctgacatttcatttggggaagtctgaggaagttggtgaggtcttacgttaataaaaacaagtgcttctttttcttcttatcacctttcagtgtctgctctgctggctcatgcagtgtaggttggcttacctctccctggaagtcacattgtccttcagaactctttttactatgacccacaaacagttttcagacctcactctgatgagtcaaaggtaaagctgtgaataaacagatggtgaaacaacatttgcagttctctgacttcagtcctccctgaaacccacttggaatctagctctgaattcagccggacatgtttgttcttcccttttcccatcctcacctactcctaaccttcagtgttctctttaccttttatttttatttttgtcattttagtagtaaatgacagggacatagttactcaatttgtaaaacattgaatggtgaggtcaaagattctatgacgagcttgagatttctaacaggttcagatggatgacagcaacattttgctggcttaattttggagctgtttttgtaggttttgaaatgcagtttaatagtgagtaatagagaagtttctttctgccgtggagctactgaacccttgaaagtaacatgctggcacatacagatgaactgtagccccacatttattccttgcttagtggtaagctgtacactgaacaatagaaaacaaaaggctatttttctttggaagagcagatactgatttctggacaaagtttatgttgtacaagttaaacattttttattcttttctggttagattttctgccttttaaaaaattagcttagttgaaaaagcaggtattattaaatacagtttattttattgaattggacggacaatcgtagaattttaaagcttaaatggctttaattgaacctaatgttctaattttacagaggaaacatttgaggcttagtgcggttaaatgaccactcctacaacacacagcctgtttgtttgatggctgaggctgaaaaccagactccagactcctaatttaatgcttttccttcattggtcatgtctttttagcttcagtgaagatcttttttttttttttttttttaatttttgaggttatttaaaaaatactttgccttgaaaatttaacatttccacttaatcattctcatacttcaagaacagtttctctgttaactttctgtttaacttcttaaaccatacactgtggaaattatctgtctatatgctgaacagtctttaatgactgcatgtgtgccgtagctgttgagatgttttaatccactttagcaaaaggtttatttgtttaagaaaagtgcagtgttgtattaagtctaagcttagaacaatgaagcatcatctcccagctactgggagtgagaatgggaggggcagggagtggttggtactatgagctgctctaaagaaaattcatttcagcttcctcacatgttaatacaatcatatttcagtgaagcccttcttcagcaacagtcactaatgatagagtgatgtgtttagacttgaaggttctttaggtgctgtttaaatgaataatgagtgtagttaattcacaatacaggtgaaaagttaaccacagagtagtggcactgctctttctttccccgtcacctctgtgcatgatctcttgctgcgccattagaagggatgattagaatgggcaaatattccctcccggtgctcctggcaataggaaagcactgtgggtgagatatgtctgcagagcagtggtatagtttcaggaagggacctcattctgctctctggggcaaagcttccgggtgcctgagtgggcctcttcctagtcgatggggcagcttgatggggtggctatttattggtgaaaacagtatccatgtcccattggttattgggacttgattcctaatttgaacttaggtgctgtgaagagacttatgtaacgctgtttaatccatgtttggctttgttagaagagtttaaaatactcagaaggaagaaatgtttggttcctttgaaaaggcagactgttcatttagctagggagagcctcaccaaatgagtcaattaaaaacatttggggattaagcccagtgagagtgctgtttttatatgagacatgaagagggtgggggaggggcgggtggaactatggggaaacagcataggaaaaaaaagatctttagaaaaggaaaaagttagccttagctcttcagagagcactgggtgggaaaaaggatttaagtggaaagaagaaaagccctagagatttttgtaccaaaaaaaaaagagtgctgttaaaaagatgaatcaacagctatattctaaatggcgtctccttaactgggatttgaagggaagagaaggcctgagtagagtcttagacaagtccaagggtaaaaaagcaaacagatagttgaagaagtggaaattataagtttggtggcaaaaacttacttgtaattagaatttttgtgtccttaatacttgttgttatgctgatatgataatatgctaataatatgctaaggaattttcccaattcataatctaaagcaaaattaactaatatatgttctgttatggaaattcacctaaattgcaccagcaggtgtattcatcccgctaatactaacactctgttactagctccactgtggcgtttccactgtaacgtggtggtgttggtgctactcattgtgacagtgtggtgtcccaaagagtgagcaagcctcgccaacgcttccttaaaactcttactgatggaactaccatgtttatatagcaagaatattagagaaagaagagtcgagaaaggattccacaacacacatctagtcttttcctctcttagcttttagggtcaacactacctttctcttggaaatgagaaggggagaaaaccttttccactattctgaaaagagggttttaaaaattctctcaggtcgcctaagctggaggggctttatgacagcactaaccagtaggtcaaaaaggaaatttattttttcccatcataggttcctctctacacagagaatgcaaaaccgtaattcttaagagttcctcaatgattattcacttttgttcttacttccatatttctctagtaaagatttaaatatttaattttgtagactcctgaaataactgcttccagatagtatatttactcagaatattatttaaatgcattaatgctgacattgttagaaaggggagaaaactcaacattttccggcagaaatcattgtaaaatgtattataaaatttcctcccttcctaagtagagtgctactatatagtgaatataatttaactttttttcttggagacttattgtcatttctgtgaagttattacctcgacatagtagcgtcctgatgcctcaaaagctcataattcttctcgatgccacagcctctgtcctatctacttgtcttggttgtcatgtcttcaatctcctttcatatttgcctatatctgtaaacttaagagaaaccagataatcaatctgataaaatcactaagctgaatcatatacattaattctcattcctagctctctccacctagccagtgtggcctgaggcattcatagccatgttctgagtggtgaaggctaagagagcccaggagagctgtccagggttaaataagacattaatatataaagtaaggactgtcggtatacgtgatatttatatgttatcatattacattttatttatttatttattcatttatttatttgtatatatagagagagaaacagagtctcactctgttgcccaggccagagggtagtggtgccatcatagctcactgtagtgtcgaactcctgggctccagtgatcctcccgcctcagcctgctgagtagctaggactacagacttgtgcgaccacacttattttttgtttttaatttattttttgtaaagacagggtctcattccattgcccaggctgcatttttaagtttagtaactgcccaaatggacattgggtaaaataaaaataaatacagtcacttctcttcttaaatcattcacctctcaagatgaaggtactaataggacattttctagaacttcagtgttaaccacagcaaggaggaaagacaggcctgttagatgtagactaagaacttcagaagctgtctccgtcctaggctgggcccagggctctagaattgtcccacacacctggtgggcttgcttgggtacttgggtggtacctgggagatgatgacctgttcatcttcagcttctgttattccaggaaacagaggtagtcatctggatactacaggtttgccagctctgctacttctgcttctactgcaggaggaggagctatggaatttttatgcatgcatcaaaacactgacttggctcataagactgcttaaaagacagagtgataaattacgccttgtttctcatgaaacagatttttcccaaaagtagaaatactaatttataatgtatccttttcagaaagattgtaagtctaagtttctcagagaaacagtgtatgtgatggcaggaccccagtaaagtccaaaatatcccataatggccttaggaccatgcccatcatagtctccatagagccatggtccccaagagccatggtgcccaagagccaccacttcagtgggtggtaggtggttgtgaagaatggtcactgtggttcacagaataacagtgacaattgtgaatagaagccagtcattacctaactgataaaatgagtgaggctagcaaagggcctgacaggaagtgaaatcacttactgaagtggtggtagagtacgcaaccaagaactaagaacaggagggaagttaaccctagggagagttcgactccacttgaggaggaacattctggcaatcaggactgtctaaaaatggaacaagctgattgatttagcagtgaaacctctgtcactggagatgttcaaacagaggtagtaggaccctcttatcaggaattctccagagaggagatgtgagttggatagaaggttattgtagacgaccacttgtttctctctcagctctgaaatgtagtccttaaggctgacgtgtgtttcccagtttctaatcggaaaagataacataatctacagtgttgaaataatttaaacaaagtaaataactgtgcttttacaaccataatacggtttagcctttcattattttgttacgttcctcattaacatagacataatttcttttaaagaagggacaattgtgacgagcctgggcaacatggtgaaaccccacctccactaaaatacaaaaaattagctgggcgtggtggcacacacctgtaatcccagctacttgggaggctgaggcaggagagttgctagaaccaggaggcggcggagcttgcagtgagccaagatcacaccactgcactccagcctggcgacagagcgagactccgtctcttaaaaaaaaaaaaaaaagaaaaaaaaaaaagaagtgacaaaacttacccagtaaactaaatgttaatttcctcttctcaggagcataatactaacttactcctctgtttttatatttttgagtactgataatcggatagtgatatatttgtgttattttttgttcaaacaattgaattcattcttagcaagaacaaaagtctatttgaaacatgtaggcatcttaggtagattaaatttttcattgtttcaagttttgacttttgtatttctgcacattagtgatccttgaagattaggcaaggccaagttcttttgacttttataattagtgtgtcggaatcccagtttttcctaccctagggtggactgtattttttacaattaactctgtgaagggtgactgggggtggactggtgaggagaggcttccagttaccagagagcctgtgacttactctctgtgcttttcctaggtcaccaattttcaaagaatttgagtataattaaatacacttcataataaactaggctgaacataatttaatctttccctgaaggtacttcagagtcttggagtgctttagggccatgatgagcatcaattatgttctcacggtgggtgtgcagaaggaggtagttaatagagttctgtttgatcaagtcctgggtgactggacatgtgttctgttatgattagcagttcagtgtccaggttttggaactgatgcttagtattaaattctcaggcaggagagaatggaatagagattgacctctttggctttgagaggctgaaagttgatgacgataattcacatgtacatggtatatatagcactttttagcttccaaagccctttcacataccttgtcttccattgcttgtttcttgtgatgttctggaaaggaagcaaggccgctggtatcccatttttacagatgaggacagtggagctcaggaagcttgagggacttgcctaagctcatacagtagatcaatggcggagaccactggacttcaaattcagtgctctttttagtatttcaaaggatactaaacatttgctcacatctctgatgttctttgtgctgtatgtgtagtaactcatttaatcctcacagtggccctgttagtaggtagatatcagttcttctggtactattacgattctcatcttcagagctgaggccactgagaggcacagagaagttagggcatgcactagtgagtggcggagctgaaatctgaacttagagctttggctccagagcccatgcactccaccattatgctacatggctactcagtgtacagatacactgagcttaagtagaggagaaagcttatctatccatatcttcccatctgcaaagacctctgcctgtatgggaggtctgggctcgttctgactaaggttttgaacccagatctgccaatttgagatcttgggcccattacttagcctgagcttcagtttccacatctctaaagtgaaaatatagaacatggaatgtacctgtaagaacacaatggaatacaggtaaagtgcccagcacactgcttattccttagccttcatgttttagaaagtggttgctattgtttttgttgttggtggtggcggtagtggtcttcttcttattattatttatatatttacaatggccaaaattatatgaaatgttttccaaaaattaggtatttgtacccttcatatgaatgtgtgtgttaattgggtataattgtctttcttgagtctttaaaatagacaaatcttttgattacatttgttaatattattgtacctacctatatctgacttgacttacaattttacttcattaaatacatagcaagtcatctgagaacccaaagtaatcatacagattacttgccatatagttaatttgtgactgtgatatggctgctaaggtagaggtttgaatttaaaagcacaaagaaaaatgtttacttcaatggttacaaatagattaatcatataaagtacatatttgcagagtctcgctcagtcgcccaggctggagtgcagtggcatgatctcggctcactgcaacctccgcctcccaggttcaagcaattctactgtctcagcctcctgagtagctgggactacaggtgcgtgccaccacgcccggtgtatttttagtagagatgaggtttcaccatattggccaggctggtctcgaactcctgatgtcaggtgatctgcccgcctcggcctcccaaagtgctgggattacaggcttgagccaccacacccggcctattctaaggcttgttctaaggctcacagatggcaccttctctgtgtatcctcacatggtggaagaggcaaagcagttcctgggggagttctttgataaaggtgctaattccattcaagagggcacctcccaagggctccactccctaatactatcacgtggggagttaggattcgacatgtgaattttggaggcacacagacattcaggccaaggcataaacagtgaccacttttgttctgtctgtccacacactgcctagagcttccatttatttcaactacatttgcttttttcttatttatctgttcagagtatcttctcagtggctatttatttaccaccctttaacatgttttcttgacattgtacttcagcctgtatatgctttgcaactcaggaactatgctggcttaactaatagtacctacttaacaggtgaaactgacagtaacagcttaataggtgctttccatttttaacatacctcagctttttataaatacaaaaaactctcaatcttttaatgtggttttaaattttaaacaggtcttctttcattttcctttacagaaaactgtaatactgcatatgcattttcaaactatgcatatttcttcttcattccatgtggaagtttttattcagcctttcagtaaattttacttagcttgtcccatggatgccgtaggtgtaaggaatatgatagtgaacaagacagacagagctcctcccctcagggagctttgccatgatacacgatgatgacaatgataaaaggagcaaataatgatttgggacctgattccaaagggatatttctgcgacacttacaatgaaattccaacctggcaccatctttttcactgcagaatgcatgaaggtggttgcatcatgtcatttcgacatgcatttaaatgtaatgaaaggcacaagtagtgattgcaaacactacaataagttgcttgttgactctcttactgtcttccttcttatctccctttcttcctttgtctcattctcagttttcagagcttagtcattatttcgtaatcctctcctaaaatgaaatctggggctctaaggacaggaggcacaggttgtgtttgaacagcatcatcgtgctttatgaaggggattggaggggagattctgccccacagtatggtcaggtctcgctccaggcagcactgactacattggtgctggttgggtaactgtggctcggcaggtcactctccctctttccacctccgttttctcattattagtagaagtcgaaatagcatggttttctaaggcctctgccaatctacaattctgtgattcatatgttcctaaacacttgagttactttttctcaataaatggaaatatattttccaatgaggctggaaatacattttccaattatcctctcccctggtttataacatatcatcaatgtgttgggacttctaacactgcttctgctgtaagcccatcaagaggttaattacctttgaagaatgaggaactgctggaaaagaactgtaaaaccttcaagagaactttggagttaatccctctggtaataggaatcaatgtcactcacacatctagttgccagtggaggaggaataacagcactgggccaagtagacttgaaggaaggcaggttgctgatagagtggagagctgaagattctgaatcaagctcatcatgactctcttcctcctctttgaggctacccaatcagagcaaaaacagtattttaaaaaacctcaactggatgagcctgatgcagtggtgtgctcatgcagtcccagccaaagggtcacttgagcagaggagttcaaggccaacttgggcaacatagtgagaccccgtctctaagacaaataataaacatcaaaattaaaattaaaaaaaacccaacccagtgttcccttcagaatcctgagtggtttgtttcatcttcctctattctggcttgtgtcatcttcctctcttgtaatggataaaaactccaaatgaagacaaaaatgaggaatttgtcaaaaaaattgaattgccaacaaaagccatctttggttgatcaaacggtacagacgtttcagttagacaagagggctaagtttctgagacccattgtacaggattattaatattattcatttttagccctcataataaggtattataaatgtcaagattgctaaaagaatacgtttttaaatgtcttcattataaaaaataagtatgtgaggtgatggacatattaatcagcttaatataatcattttatagtatatgtagctatatcaaaacatcacattataacccataactacatgcaattattatttgtcaattaaaaatacaaatctaggccaaggtgggaggatcccttgagcccaggagtttgacagcagcttgggcaacatagggagactccatctctacaaaaaaaaaaaaaagaaaaaaaaaagaaaaaaaaaggaaggaaaaaaaagaaaaaattgactgggtgtggtggctcttgcctgtagtctcagctgctcgggagctgaggtgggaggatcccatgggcccaggagtttgtggctgtagtgagctatgatcatgccactgcgctctagcctgagcaagagagtgataccctgtctcaaaagtaaaaacttacaacaatataaaaaataaaaatttaaattataaaaagccatcttctttcccactccttcccattttgatacaacagtcccagaccccagacttgctttcctcatgagtcatgcagactcaagtattgcagttccaaaacactgcctgactcaccagctccatccaaaagagtatgtattgtcttcatatgccagataggaaattcctgctgcatataggaaaagcagtgtgtttaaatacatggacacacacacacatacacacacacagagtacacatatacacatctgcatatacacgtacacatatgcgcacatattcatactatatatgtacatacacatgcaatacacatgtatacacaccacacacacacatacacacacatgcatctccaagtctatttccatgctttttttcagtaaagcacctagacaaaggagagagatgtctaatcaggttttggtggttgtcagggatatcataaatgagaatctcaagttactaaacttgatttcacaaaatagtttattggtagttttagaatggcattgcattttaggcagccccaattgtaaataagtgagccgggtaaaagcagattggatgtcacccagaatattttctggaaaggggacatacacaaaattctctctttgcacaattaccctgttttgggtttgcaatattatgttgagcaaggctggctattttccaccaacaggatgttacagcttgtcaaaagttattcaacctatagtgttaagcaggtacttcatcattactgaatttggttgatgctctatggagaaagccaaagttaggagttttgtctgtcattgaggtagagaccctcaactagggaagctttgaactgttcatccagctggtattctgtaccaccttgcctctggagttgagcttagaaccctacttccattttttctgtcacttcagggctgtttcaactattgtttcttcatttacttatatcaagtgtgttttctcaattcataagcatgggagaccccaagagacagatatcgcattagtccttttttgtttgtttagcaggaaggtttttaagtaaagctcctaaatgatatgtctcattctcatggaaattcatcaatattgttttactgtctcctatctggttactttttattttaggtaaccactgtgatacaatatacacaagtccctggatcatgaaaataaattgaagagctaatgttaatagtaagttctcaaccaggggttatgctggaacccaggatacataacccacaggagggccctccgtgaactcagttttcatggaattgtcccataccttcacaggtagaagcatggctatgttaaaagtggccaatgaaagtatagtttctttatgccttatactttgtttggtgaggatttctgccagaggtgtttgtttcctttagttttctggttgctatgattttatacagctttggtgacctctatgagtaccagataaagttaggtatgataaaggcacaaaaagaccgtagaagccatttgtattctaaatataaatatacagactaaatttgtatgcatttgtgtcttcattcttcacggtgctgtatcctccgtgtgtgtgtgtgtgtgtgtgtgtgtgtgtgtgtgtgtatttcttctttgattccaggctgcttatacgaaaatgctgattcatagtgtcactgtcttttctttttcctgcgaaattctaaatccgtttctaaactttttctacaactctgagtttaatctctctaaagtttttttttttccctcttgcggacacaaggcactttgctttgtttatgctaataaatgtcagactagcccccaaaaattagaagaaatgccagtaatttcaaagggctcttgagcatgattttttttcctgtttcttaatacattgtacttttcagagtttaagtttaggtgcatgtaggtggtattagaagattcttagattttattggtagcatccagacaatcttgtcatcacccgatatatatcacctctatgtggtagacccttgtggaaattttctcatcacgaaagtcgaaagtttaattttggagaggaagaggtttttcagatacattaaataggttttgctacaataaggtgagatggtactttcaattgagcatttctcatatactagcaagcagacagcttggcctcctggttgtaattacatgccaatggcttggtgctttttattttagaagttgagttcatcctgaattctctgagcatatggagtagtgcactctgattgttcccattaagattgtaattccatccaaggcttatagtgtcattgtaaacactagatggaattacagccccatgcacattttggaagactgcattattcattgaaatactttataaagttaaataattttgtaaatatgctccaagttcatgggacttagatagaaacataatcctggccacaaaggaggttctcagtaaatatttcttgtttatttgatggactttccttatatctttaaataaactgtatttttaaaaagtgtagagaggttatacttaaatatttgtaggactttaaaagatcttgccttgaaatgctcttacggtttcttgcttttcattgatggaaaaattgacttcccatatgaatatgttatttaatcttttctgtttctagcctagagagaaatactgagtagctcgagtggtcaagaatctttattttagggacatccgcatgtcctaagtaattcccttctatataaatatctcttttcggcataatgtgttgcatgccttcaaggtggaccactatgaggtgaataattacacaacgggaagcctggctgtctcgtggaatattggatggatggctttcttattggtcttaattaggacagtgttgttaagataattcactaattcacagtgcgttatcagatttgaaatgacctcttttttttatactacttcggaagtgtatgtataccttttaggaaagacctggaaggataagttgtatattttagtatctgatatggttttaaaatttaagactctgtgttatgtatgttttgggatgactataaataatctgtgtaacaaggtattaccaaaaaccttattgcctttgccaccatgcactgcaaaatatagtatcaggaagcgaaaagacaatgcattttgagtaatttttagaatttgcatttttgtgaattgacatgtatgtatggaggacttttcaaaaaaaacagaacttttcattaagaatattcggtattaagatattgttttaaatgtcagatatttttaaaatatatgaaaccatattaatcacgtattacttatactttttgtccctggaaatattccatttttaagaacagagataacaaataaatataccagtaaagctaaagtcagtgctttctgctcttaaaataatttattgaacgataaaatgaatgtctttgctttgtgaaattatatttttgtttaggacttgataatgcttagagaacattttagtttttacagtttaaagaatgaataatgactggttcctctgctccctgatttgtttccatgtagatagtacttcatttttattacctgtaaacatgtgttagctttatcaattaggctcaattgaatgaagcataaccccctgaaaggccttgccagtaaaataataatagtaataataatattcttttcttcagattctagcagggagtactgctggcttttatgtaagaagtcaactttaaaagtgtttttgtgtgcgtgtggtgtgggtgcagcagcaatattgtgtattcctttcaaatcaagatgcctcatagtctgtgggcgggggaactccctaagatgccctcactagttactcattcatttgttcctccccagaaagggaaaacccaatgctccacactccacttattctgaataatgggggcggggaggtggtggcgtgaggatgtcagtgtcattgggcaaaagccttcatttttaaagtttagcaaaatgcagttttattgctttatgatcagtgtgtattacaagctaatatacaaatggcattagtgatcaaagtgggatactgatgtggcaaaaatttacaatacacttaacagattgacctgacataacagtgaaagcatttgaattccttcccacatagtaagtaacaagtaatttctggagccagaagtgggagggtgtgtgtgtatgtgtgtgtgcatgtacgtatgtgtgtgtgtgtgtgttgtctgtagaagttaacaaatatgttagttcattgaccatttctttcgttgtcctaaagaaaatttcactcacttgtgcttctgatttgtttcccgtgaagtctcttatcactcttagaacatgaaggcgaattaatgaagaatccttaattcttcaaaaaaaaaaaaccagccctaatttaagaaaggagacatttaacttgctaataagatcctaaaattttataggttatataatacattcaaggaaattgaattatatattcattaagaatacattatctctattagcagagagtaaatgattgaggttttactgaacgctaaatgctcagaaagtaaatgcaaagaccatcactggttgagcacgctgggaactgggtggaagtcttaggcctgtcattaactgttgtgcggcctttggcaaataaccgaagttctctgagccttaggaaaatgaggaagttgggttatataagtggttttcaaatgtggcttcagaaaaccctggagagccactgcactccagcctgggcgacagagtgagacaggcctctgtggaattagccaagggtttgggtaaggggtggggctgagacctgagaatctttatgttacaacagctattaggcaatgtcagttcacaggaccactaaatcaaacaatccttcagaccacttccgactctcaagtttcaataagtccctagaaaacatcatccttggtccacaggaagcaatccaataaggaacttggtctcccataaagaatccaataaagaaaactttaaaatgagaggagggttatggatttgatcatctccaaggacccctgtcaagcaagtctaagatctttccaaaggagatctgagaaatatgtctgtatcccaagaaggtttgacaatagtccctgaagtttgggggatgacttctagatatccctgtgccttcaagcgtgatcatgggctggatttgttggccccatggtctgcctctgagtcacagacaaatgatgaaaaaaagaacaattttctgtcagcatgccagaccaagggaggggccaggagaagaaccgtgaaccatgaactgtgccactgctggaggcactgacagctccttggcaccagatgtgtgacctcaacccctgcagcttgggcacagataatatctcagggcaggggatgaggaatagaggaagaagggaaagttgcagggatcctggagtgttaatacccatggtggcggcagagcaatttgccaggaagaaaactctctggttaaccctccggcactagttgccaagcatgtttgtactagaatggagttcaaagttacaaacagagcactgtctgtttttaaggactcatatgaaaggtttgcttgtcctaagcctgaatccaagagtctgtctgtcataaacactttcaggtagcccaaaaatcccttcaatgtgatctccagaataggggaagacaaaggactcaggtcttcagctgtctgatgaggagtgagaaatttttctaatgaacatctctggcttatggatattaaggagagttcagtgtcaaaagtttctgcagcgtagttaacagaggtggaaagttgaaataaccttaaaggcactgaagctgagaaactgccctctttatcctaacagccacagttagttttggaacactgtccatggagaagctcagggctgtcaatttagaaagcagctgtgtgctggcccattgggcaccatctttctctcataggttgttctagtccaaggtgaagaaagctacattttgctctaagctagactgacatatggacttctagatttgaaccctaaacacaggaggaagtgattgattgtattacaaaaagaatcttctttggtaaataactatttttttttttaatggccagatgggagaaagcaaaagatgccttttcgtggtgttttggaaacctagatctcatcaactccctggttggttttggcggtcaaggctttttatgccagagcaactgtgagccaggtttctgaggttcttcctgacccatgttggtagcctcttaaaaataactgtcattccaagttcagctaaaatatataactcaacaaataaatacatataaagcatatgaatagaagcgggaaagtgaggattaacagactggagagtaagagtcttgccatgtaaaatactataaaacactcttaggaagtctcttgcttatgttattacttgtacagtaaatgtggagacctggatctcttcctcatggtcccttatttcttgttttcctgctgggaggtttcaagtagctgatcccttgcacatgtactttaaaacttcaattatatttgtcactggcttatcatgggcaatgtatgtgaatgtgactaagggtcctgataaattaaatgccacttttacatgttcctttctttttcttctattagtgttctttaggactttgaatgggaaatcctcaaacatgtaagtctatgtggcttcagaaaaccccagagaggccaggcgcggtggctcacacctgtaatcccagcactttgggaggccgaggcggacagatcacctgaggtcaggagttcgagacaagcctggccatcatggtgaaactgcatctttactaaaaatacaaaaattagctgggtgtggtggtgcacacctgtaatcccagctacttgggaggctgaggcacgagaatcacttgaacctgggaggtggaggttgcagtgagctgagattgcatcactgcactccagcctgggtgacagagtgagactccatctcaaaaaaaaaaagttctccccagtggcctctactgaattatccaagtgcttgggtagggggtgatgctgaggcctgggaatctttaataagaaagaagaagggaaattccttatgttggacccaacattgagtgtgttcagatacagatgttggcaggtatgggggcattcggaaggagaacagcggctaaccaagctaactgagactgagttcaagattcgcttctggttcagggggactttcgttttcaggctctaatacattcagaagagcaaatattggtactttaatcatgcatcttttccccctcaagttctgtatctgccacgtgtatattttatttggcatttaaatgcacagttcttataattgctgataaatagtctccattgcacattttgctggcactgtggcctcactgtaaatgctctctgtatgttcttgggaagttgcataatggcagttactctagtttactgtgcaatatgctcagtgactaatggcctaatcatgacttgaaaaatatataaacagttcaacagaagcagttgattcactgagctctttcatccagacaagggtgagctaatgggaataaaaaagacggaggtgtgcagcagcgtctttgatgtattgaagttagagcattcccacaaatcccatgcattattgctcattgatggcggatcctttttcatatgcatgaggcaggagtgccaaattatcgtcctaattggctctgacttggtattccttaatgttcgtgttacacttgttacaacttttttcctttcctctaaatactactgacagtaacagctttggagaggcaggctgtcacgtggccccatggcgtcaccctacactgcaggcttaagtgtggctctggtcctgtgctctggtttcttgggatagaattacagctgagactgtgcagtgcggacctgcctggtttacttcaggggcattgttgattgacacagattcttgttcccttgtcctcagtggcaccttttcttccaagaggaacagagatagagtcttacaacagccattaaatagaagatcctggggtctactggagcactgtcccattggtggggagaaataacaatcatcatcatcatgtctcccttcctttggaattgattaggtagctcctatattccacattcctctcacctgttgaccacacacaatttttggtcttgtagcttggccactcattttagctcaatcactggtttaatttttttaatgaaatcactcaatcgatagaggctaacctctcgtagatgtaataattccaaccattctcaaagaaataatgaagggtggaatattatgctttctaaaataatggaatttattttttctttatgcccacagctgtttagtcctaaagagggggaagaaagaatctttcgatcttttggcatgttccatgtcccgtattgatggtcatacttcagcttttttctggttgtttaagaattatgtggccaataggctgccttgtatataacagtgaaaaacacccattacttgtatttgtttcattttaaggtttaggcagttggagcataggacagtaactggtttcccttgttttctggaacctgccccttgctctctcttgggtgatgcctcacccctgccccagtgtcagagctgccctgggtccttcttcccttgaagggtctgatgaatgaaccacacagcttgttagtatctcagtttgttaatcctcccggaggaatgtatgtttcaaaaaagaagctgaaaagtataatggatgagaatttgctttggaactcagcacactgtagattagagaaggaaaagaaagaaaaggaaggaacagaaggacatgtttggggggtagggggcctttctggggcttctgaaagcaaatgttgtgataattagttacagtgtcccaaagatgcctgggtctacccctgaccctctacacaggccaattctgctcccaccagaaaaaaacaagagtacagagcaaagaggcagggcagcagcctctgatacctatttgaactttacacattctgatagaatttattatctgtattgaatatgggagactgtgggtaaaagacttcaagacagtgaaaaactaggaaagaaaaataaaggtgtattgggccttggcaaatttttgacacttacttgactatgtgctttaactttttgaaaaggcagataatatagcaatcacattaaatatttatctttaaaagaaattattttaaaaattactcttaatattaccacattatgaactcaataggagatcctacagttcctttaactttaacaacagtacatttgttaatattcattaaagttaaagaagcttactattacaacagaatgaagtaatacttgctggaaaacaccaatattttacttatctttatctaatccccccgtttaactgtagtgatacaatacttaattttaaaagaggaatggtttgaatgtacagacttttacatgtgttcttccattgagttctttcttgtagtctaacccaatagttatcacacttcagtgtacatgaaaagtgcagtaaaggattgtgcagtatacataaaatcctgtgtggagtgtcttgtgggaaagccaaaggattttcaaagttaattttgactatatatgacttttgcttaacttttgaacttaaccgcccacataaaaactcactccactatatttcccttctctttgcctccctacttctgtcccccctttctcccttttttccttcctcccttgtattcttccatccatccatccatccatccatccatccatccatccacccacccacctatccatctatctatcctcccatccacctatccacccacccatatatccatccatccatccatccatccatccatccatccatccacccactaactcatccatccatccatccacccacccatccatccatctattcatccttccacccatccgtccacccacccacccatccattcatctatccttccatccatctattcatccatccacccatccattcatccatctatctatttgtccatccatccaccctcccacctatccatccatctattcatccatccatccatcttttcttccatcactcctttctttttttttttttgagatggagtttcactcttgttgcccaggctggggtgcagtggcgtgatctcggcttaccgcaacctctgtctctcgagttcaagcgattctactgcctcagcctcccaagtagctgggattataggcatgctccaccacagccagctaattttgtatgtttttgtagagatggggtttcaccatgttggtcaggctggtctcgaactcctgacctcaggtgatccacccgcctcggcctcccaaagtgctgggattacaggcgtgagccaccgcacccagccccttcactcctttctttttctctttccctgccttccttttgataaattaacttaaacattttttttggtgaaattaatatggtgatgtctacttatatttaaatcagaaaattattagtatgctgaatattccaatctcttaggaatgataaaaatattctataaaggtcaatcttaattccacatcctatgttcctactcagctttctgtctctgatttctcatttttagctgggaacatcccagccaaaagacagccaggttctctgtgagcatagcatatcaaactaactgtaagaaaataacattttggcttaaaagccatcttctaatataagatagaataaaaatgataatgattggtatactatgtggcattgttagtaagaatttgaagtaagatttacctaaatcgctgaaaatattgaatagttggctgagactttagaattggtacaaacatgtacattttctcaaaatcaaaagaattaaaatagatatccaagaagtcagattatgaaaaaataagatagtcaacggaaatcctaaaagtaacttaaacattggcattggacatatttcatttgtatttctgccatagaagagttaagttaatgtgcatttttgccatgcaatggcaaaatgaagagacttttttttcccttctttttgctcttggtaaaattaagtggcaaagaaaagatagctctgaggttattgctagaattttgtgctaaaaacattttggctagagcagcaagtttttaggcaaacagcccctgataaaagttgcaagaaaaaaatctcattcgagtgcaccaaacacttttcagatgaccatttaatttttttaagttgcataaacaatttcaagtgcactgtaaatatagaaaatagggtatgatagttgacagaaacagaatgaattaagagcagtaatagaaaattgtaaacaattatatctgaatttcatcagttgtcttgcttacattcacaattagtcatcccgtgaaagacataggtgaacatttagctgcttaaaaaggaattagctgcttgaaaggacaaatgttcatgttaaatttcatgaagactaaccttcagcagacaacggcacaaatgtgtcagctttttctggtgtgaatgaagcaagatacaggcaaaacagatgagataaataggacttggaaaaaaaattctactatacaagttttgtatccccatctttttgctctttgtggagcacctactggaaaccactcctgacctaatgatgaggacacagagagaaaattcaataagcaatggcctgaaaaataatttttatctaagtattagataaacgcagtagcatatttgacttgtaaaaataacatggctaggctttgtatgcctccctgtcctcttacctacgtgggattttcaaatagcactgattctggggaggggaatcaaaaaatagaagactcccctctcccagagcacacgtaattaatgcctgtgttgcagctgggagctctctgccagcagagttctttgctcgtcatctctcagcgctcacccacattccccttgattcacaccgtattgtttgtttacatgtttgtctccctgactcaggttggaaatctttaaggacaaggacaacctcttgttcctttttacatttcccatggtgctttgctcgcagtggccactacagacatgattcattcattgttttaaaaaaagtgttaactagttaagtgaaaataaaatgaaacagcaaaatgagacaaacgcctagatctgaaaggctacaaaatacagcagagggttcagtggacataagaggaaaggaacacaatgatatccccaatcttgtgatggaatagaaaaaaaaaaagtgattggtgttgatgtaacacttttcttggccagttgaacattccagagtagaggtcagttttgtagttaaatctggtaggaagatgtttccaaccagaaggaatcatactaaaattattttatcacaacaagcagtccataaccgaaactttaatttgtgagttgggaatcaggataggaaacccaattttatattctttttataggaagaagaatccattccaccactcagactgctttcctctttcataatcgtggcatactctgccattgtttgtttattttccccacaactagatggagagtgcaaggaccatattttactcatgtgtatcctcagggcctagcacaaagtaggcactcagtaatgaagaagtaagatgtttcaatgtccctaacatttaaaaggatgtatgaaactagtgctaataccagaaagagttggttttcataggctgttaattgtgggttttgaaataatgtactactttgtacattgattttatacaactgtgttatatacttcagtaactttcaaggtaaaaagttagaggttattaaatctggcagggtcttaaaacctgagtctcagtccatgtaagagcattcttttgctcttcttgactagccatgtaaaagggtgaatgtaagttagtgaattatcttttagaaatcttcagttgtatatatatttttttcatcgaattgcaaactcactcacacttaccaatgtaatactaccctgttgatgagcattagtagccttatttgggtagccagattagagacacaggcttcatggtgttacctgccttgatgttttcattcataatgcagcatttgggaatgcagcatttttctatattggagacatgtatgatgatgtgtatgttccttccccataaccctgtccgcttctcctttggcagtgtcttgcatcacaattttattttatttttatttatttatttattttttgagaaagagtctcactccgtcacccaggctggagtgcagtggtgcaatcttggctcactgcagcctccacctcccaggttcaagtgattctcctgcctcagcctcccgagtcgctgggactacaggtatgcaccacaatgcctggctaattttttttatatattttttttagtagagatggggcttcaccatgtcagtcagactggtcttgaactcctgacctcaaatgatccgccagcctcagcctcccaaagtgctgggattacaggcgtgagccaccgcacctggcctccaattttaaatatatgtaggctccatctccacctctccctgaaaaaactttccctgctcctttcgccttcatgtgtgccataagttgactgccatcaggccaatatcattacatataaattccctccacccttcgttttaattttaaaatatctgaaagggggaaagggagaagattccctaatgagtatgttgtgtgattcaggaccttggctcttagatcctcagtcatgtgatattttcagattttatgggactatggtgcaattgaagaaaggcttttgacagaaaatgtgaaatgatgaagtcttagcacggactcatacggcagtatttgattgcgggttaatctccaaacgttgaaataaagtggatctgttaaaaagccattggttactttcagttgccaggggtgtgtatgctcacattcctggaagcacattctataaagtcaccaatctacaacacagacacccacctccccctagacttcagagagctctgctgggctgcagctttctaccaaaagagttgtgtgcctctgaatttcacatccaaccttggaagctgcagtctgtttaagatttcagaaagaatgggggctatgtttccagtttactgctttgttattttgaaattgaaagtctgagcagaattcagaactacacaaaacaggatcttttcacatgtttgtttaagtcatgttcttggcaaaaacttgctgaggaaatgatctgtttctctaggagcattgatttcttactccagtacagtggccatttcccaggatctcattccaaaccatctgttttgccatcagagccagcctttcagtgaatgatctctttggtctacactgtgctaaaccttctgattgaaaggatttttattaatgaaatctaggtaataaagttgcagtgaactttaggaagttctctgtaggcagggcgtggtggctcaagcctataatcccagcattttcggaggccaaggtgggcagatcatgaggtgaggagtttgagaccagcctagctaatacagtgaaaccccgtctctactaaaaatacaaaaaaaaaaaaaattagctgggcgtggtggtgggcgcctgtaatcccagctacttgggaggctgaggcaggagaatcgcttgaacccatgaggcggagcttgcagtgttgcagtgagccgagatcacaccactgcactccagcctggcaacagagcgagactccgtctcaaaaaaaaaaaaaaaaaaaaaaaagaaagttctctgtaacagtcaaatagcaagtgctgacctctgtcgcctctgtagcagcagtatggatgaattgtgagcttgttggctaggttgggctgcgggtcattgtggaaaagccatgtttcccttgcctgtggctgggaataagtatagtggggccattttaaaaaaaagtcctgtggttgaattctgagtttgagctgttttaaaatgtcaaacagactgaatccttgggagactcatttgaatgagaccagcagcaatgtaagaatatatatatatataaaacacgttagagcatttccatgtatgggagggaactgatggagagaacacagaccaccacattaactgccacatgctgtcaaccagtggatctcaactggggaccattttgccctctcaggacatttggcaatgtttggagacactttttgatcgtcccaaatgggaaaacaaggtagcaatactggcatctagtgagtagaggccagaaatgctgctgaacatcctgcaatggggctgggggcattggctcacacctgtaatcccagcactttaggaggtcgaggcaggaggatcgcctgagctcaggagtttgaggctgcagtgagctgtgatggcgtcactacactccagcctgggcagcagagtcaggggtctcttgaatgaatgaatgaatgaatgatttttaaaaatcaatcaatcaatcaatatcatatcctacaatgcaccaaacagtcctctgcctcaaccaaggatcatctggcccaaaatgttaatagtgctggagttgagaaaccctgccttagaccctttccttctcatagtttccaagctgataaatcagcctgccttgacaaaggtgaggaggtaagctgcaggcgtgagtgggaagagcaggataaggaaggaaacggagaaaagaggtagcagcattgcatgaaaataaactacccgggccatatcccatttgtgccaaattaatatttgggattctgtctttatgtgtttggtaaagccggaaagtatgtgggtggctggctgggccatggcctttgtgttagaggtgacctgagtttcttcaaagcacctgtgttagtttttcattgctgctgtaacaacttatcaggaactttgtggcttaaagcaactgtttttatctgacagttctgcaggtcagaaatccaatacaggtctcaccaggctgaaatcaaagtgtcagccaggctcattctctgtagggactctagagaataattcatatccttgccttttccgttttctttcttttcttttcttttttttttttttttggcgggggggaacggagtctcattctgtcgcccaggctggagtgcagtggcacatattggctcagtgccacctccgtctccaaggttcaagcaattctcctgcctcagcctcccaagtagctgggagtagcccagcaccatacccaactaaattttatatttttactagagtggggtttctccatgttggccaggctggtctcgaactctcgacctcaggcgatccacccgcctcggcctcccagagtgctgggatcacaggcatgaaccatcgtgcctggcccacctttttccattgtctagatgccattgtatttcttggctcctggccccttcccctatcttcaaagccatcaatgttgcatctctctgtgctgtgtttccatagttgaatcttcctctgacacttcttcctccttctcagacttttaaacttccttgcgattacattggacccacctgtatcatctccccatctccagatccttaatgtcatcacatctgtgaaatcgcttttaccacgaattcacagactgattctggggattaggacgtgggtatgtttgaaggtcccttgttgtgcctaccacagactccaaggcatttactagagccacattttgctgacttgagctagatgtagcaaaagaagtgttataaaaatgggtttttaaaaaagcctttttttttcctgtggtataattttagtgtttagaagtaatttttcttttaatgcagtatgacacagaaaacatttggaggatgttgaaaagtaattgtttaaattggcaaagacacatttcagtaagggagtaaacaagagggaaacgtgttggggggaaaggtgtggggaggaaactctagaccagaggccctaggacttgaatatacaacttagtcctgttgaaaattcagattcctgggccttaaagtatgttaaataggtcaggggtggggcccaggagttgtacttttaacgagcaccctcctgtgattcatttaacataaaaggtccttggctcacacttggagaaacactgctgtagaaactcaaatacctattttaaaacaaaggtacattttaatcatttagtttaaaatgaaatcattgcataatactgatgttagaggttagaataaacatgtacttaagttcttgatattcttgtcatttcagttacatgtcagggaatgtgatttgtgttttgacgtattcaaatccttgtcatattcaaccatattcgtattcaaaatatataatgattttgacccttgattgttcgaattaagactgtcatcttttctgtgtgattaactcttgtgttgatataaatatgcctttggcttactaatgttcagtaagaactaatgactcttgggaatgttaatagactctgtgagtccctttttaatcatttgtaaccaggctgtcattccatgtttgtttggaagcttagagataacatttatgaactttgtgacacatagtagttgctcaataaatgttaactgtagaaacacattgattagtttcacttcagaaatagacacttagagttcaaaattcccatctgcctagctcctgaggcccactttcttaccagaatctttcctgataccctctcctgcataaaatggttcctcttttgagactttgtagctcttttgtacttctcttattctgttacgttactgcaaaaaaaaaaaaaaagaaagaaaagaaaagtgccaattgtgtacatgctttcctccctgctggaatgtaaactttgtaaaggcatgatccatagcagatacttcttattacaaactacctggcagaatttctttctaaagaacctactcagtaagcctgttggtgaactgagcaacatttggacaattatggcatcatcttacaatttttcagctattggttttcacttgtttagaaatgtaaaactttgcaaggacttttataaaagcaaatttcagaatagttattcactaagcttttttatgctaatgatgtcatgctatcaaaaattagctagagtaaatggactgtaatgaggatggtttgtaatctagattatatgttccacatgtaacatcgaaatgaaatataaaattgagttgttggcatgtggttgtggtgagcagaagcagttattatacattacttggtaaaattcatattcatatcttgtcagtttacagtgagccagagattaaaaataacatttgtttctgttttagtaactgcttaaaaatatccaaaatcattttattttctttagcctgacttctagtagtgttttgaatatgtggcctttcaagcagtaatgaaatgcatcaatgcgacttggcagtgcctcacaggacatgcttctaggatcatttttaatgattaaaagtcaaattgagttctaaaaaactgacccaaaatatagatgagccaagtaaaaacggaaggaaatctgaataaaatcttggttcttggtcctctgcatgtatcctccacatctgttttctccagatctcttttttcttgcttgttgatagcacagaggaagatcgcagagagtaatgtactgtatatgtttcacatcccccttcctctttagtgatagtttggagagtatactgcagtcaccatggttttcagtttggagagtacaaggatcagatctgtattttctagagccagcttttgtggcattctggagaggtgattggagaaccatgagagcaggcagacatctgggtgagagggcacgaggggtgagtgacggcagagccagacttgctggagaggcagaaagggaaggattcaagtagcataaccaggaaatagaattgataggatttggtccctgctgacctgtggaataagggggaaggcagaggagttgattctagtatttctaagttgggccacttagtgatattggggtaccaggaacaggcttagtggacccacagaagtgaccagacccaggagtctctctgagcgcccaccctggcttctctgtgttggcttaccctttcttggttgggggtcatggggtggtcagcttcagtggtgtggtctgaggtgacaggtgctcaggagtgaggacagggagtagacatcaccaatgtgaatgtggaggtaggcaacaagagttattctagaactgacaaatttaatatattttgctgactgctgagttccatttggacaaatacctaatgcatttggggcttaaaacctagatgacgggttgaagggtacaacaaaccaccgtgatacatgtatacttatgtaacaaacctgcacgttctgcacatttgtcccagaacttaaagtaaaaaaaaaaaaaaaaaaaaaagattgttcagttcagttcagagagcaataggagcagtttgctattcaccaaatagggacatcaattctttactgattaatagcagtgattcagaaaactgccttttgtagtagagcacaccaagggggtctgccggatggaaaaagagaacagtgctttgtgaactataattgttgccataagtaaatacttaaaatacactaaaatggcaacatcaggaaacatgactaaggagtcagtgtacgccacgccctttcccccacctttgtggttgttgaaaatttccaccaagagtgatgtatacaaaaaagggtaagatcagggtgttaggtttcagaggaaggcaaaaacttgtgtgattctataaatggagcttacaaatggaaatgcaccattcaaggcagaaagtctatcacagtcattaggaataagcattagagtgattctcctttcttaacttctgcacagaagtttgatgtggtaaagaaacagtctgctcttagccatgttccttgaaaatacatgtcttcaattacttggtttgtctgagagaaaggagggtttggaggagaaggaaatgcctcgtgagtttgacatactatgggaggattgttgttattattgcttgatttacatgctctcattttatacaaagtgtacagcacaatttctcaaagagtaattatgatgccaagaaaatggggtggattctgggcttcctgcagtctgtcatccaaataataatattcattacaaagatccttacccaggaggccaaggtgggaggattgcttgaggccaggagttcaagaccagactgggcaacatagacccctatctcaaaataaaataaagtaaataaaataaaataaaataaaaaataaaataaaataataaaagctccataccagtttgtggcattcctactgaaaacagaggtatacgaaatgcttgaacagggcatggaactggaggtatggatgtcattaagaatggctgagaattttttgccaagagttagtatactatcctactttattctatttcagtttgcagtaggacagacctaattctcttccctgagaaagtcacaaataaactagcatggagcttctcagtgggcacccttggctgaactctatagactcctgttctctttaataatatctaaagcttctggttcaattacatggctaatatcttgactctcaagaccaaaaggcaagatgtttaaaaataaaatcaacgttaaaaacatgcctgtgttccatggacacaggaaggggaacatcacacactggggcctgttgtggggttgggggaggggggagggatagcattaggagatatacctaatgctaaatgacgagttaatggttgcagcacaccaacatggcacatgtgtacatatgtaacaaacctgcacattgtgcacatgtaccctaaaactttagtaataaaaacaaaaaaataagaaaacaaaaacaaaaaaaacatgccagtgttctttagtcctcactcaattagagaaaaatgagagcaagcatgatattttgtatctggcactatgtgcactgccttgagagatttctctagaaggttttaagaacatctgtcatctattaatagttacgaaagccgagactcacacaaatgaggcaacattacagggggtcagagagcacataggtaagcccaccttgatgggagtcctggcccgaggcactttggggaaagagtgagctgcagtggttatagaaagacaaatgtcttgagccgggcattgaaaaatgactaagaataatctagaaagtgttcagtatgtttttaacgattgtgggttagcagaaggaaagccatctgaggtgagagaaataataagcaaaggggacagaggtggatggtgaatcaactgacccaagggagttaagcgtttagaaagcacttcaaaaggataacactacatagctccttgccttactgtggtgccttagagatgactggcatttttgcagagcttgtttcataaatgtgctttcagaggaataaacaggggattcgggctgggctgaggataccttgaattttgtttacagaccatcattttgtttacagaacatcagtgctctatcctcatgtccttctaagaatcaaaagttttaacctcacagaatccagcgtgtggcttgtgagtgagactcctttttccatgtgataaccggtctgctttggggaggcaaaagaatcttaccgacacgtacatattttaggatgggctctgagccaattcatcaagccaactcctcactttgaaacaagaaagtgaagaggatgtttcatgattgtggaatacctgccagaggaagaatctaccgaagttcagtcaactattaattggaaaggaggcagcagactgaggagatagagaatctttgctctcaggtggatggaggttggagtcctcaatctgtcacttgtgggtacattatgtagctccttcacctccatttctttatttattagaaggcgggtaataaaagtgtccactgcctaggatggttctagggcttagaggagataatgaaactcaagggcttaacatgtgaatgttagctattatcattgcatgtgtccattaacacccaaagataaccagtgttgtttagtagttctttgcgtattttctttctaaatagataatgatttataatttacctagttacttcatgaattgatttcatgaaaaaggtctttctgaatctctttccatgtactttaaaagtttattcctttagttaaaagaaattttaactagattcttaaagcctagattggaagaaagtgtttgctaaaaaaaaagtcatggctgggtgcagtggctcacacctgtaatgccagcactttgggagaccgaggcgaacggatcacaaagtcaggagagcaagaccatcctggccaacatggtgaaactccgtctctactataaatgcaaaaagtaactgagtgtggtggcatgtgccagtaatcccagctactcgggaggctgaggcaggagaatcactggaaccagggagtcagaggttgcagtgagctgagatcacagtactacactccagcctggtgacacagctagactccaaaaaaaaagaaagaaagaaaagaaaagtcatgtatatatccagaagaaaggaaatcagtatattgaagagatacctgcactcccatgtttgttgcagctattcattatagccaagatatggaatcaatctaagtctccatcaatgaaggaatggataaagaaaataaggtacatatacacagtggaatattattcagccatacaaaagaatgaaattctgtcatttgtaacaacatggctggaactggaagacgttatgttaagtaaaataagccaggcacagaaagacaaatatcacatattctcactcatatgagggagctaagaaacatgacgtcatggagacagagagtagaatgatggttagcagaggatggaaagggtagtgaggagggaggaataaagagaggttggttagtggctataaaaatatagttagatagtaggaataagagctagtgttcagtagcacaatagggcaacaatagttaacaataacttattgtatatttcaaaataactagaggaatgaatttggaatgtccctaacaaaaagaaatgaagtgatgggtatcccaaataccttgatttgaccattacacattgtgtgcttgtatcaaaaaatcacatgtacccaataaatatgcacaacgatcatgtacccataaaaataaaacaaaattaaaaatgcacacttctcacagtttcttgcctagtagaatccaagtaaatacagttttccgcccacagataactcttccctctggtgccctcatggtttatctcatgttcttgaccacatgggttaatggtctttgttaggttgtactcagtgatccccaagaggacaaatggtgggaattatggaaattgaggccagaaggaaacctagagttctgtgcttttacttccagtagggatctgtggggtttagaatgtctgcctggtcagcagttctcactttgggaacccccccacccccacccaagaccttttctggagggacatctgtaagatcaagattatttttatggtaatactaagacattatttacctattccattcccattctcttccatgtgtacagcggagtttttcagaggctatatgatgtgtgatgatattgtgtaatgaaatgtgtcaacttttggaagatttgcataattcactgaactaatataattttccaaatgaccagggtatgatgttacaaaatcatgcatagctaaagatccatccaaagttcaagatagactaatgaattttaatataaaagaatacttagagtttatttctatgcttcagattccatggtgctgctcccctttaagaaactaccacttattgagttttggtatgatataaaaaaagaatatccacaattgctgaaactattggccacatcttctccacatacttcaaccaaacaacatatcacagaaaactgaattcagaggcacagaagagaatttaaccattttccattaagccaggcattaaagagagctgcaaaaatctaaatggatctcactcttgtcactaacttttttgttctgaaaaatataattattttttcataaagatgttatttcatgtagtatgcaatgggtatattagtatttctattaaatgaactaatgaatattttacatttttctcaattttgcttctaatatggtataatagttgttaaatatgatctacctaatgaaaagttccttggggtcctcaataaattttaggagtatagaggaaactttatactcttaaaatttattgaggacccaaggagcttttaagtgtgaggaccaaaagtgtgaggaccactggcctagtctggtcagtgtctacaccctgtgtccactggtttcacctttcttctggaaaaagtgttctgtggtaaaatatattttgggcctagatgagtgctttctcccctcatagatttacaatacacatgaacatatgagaccctccaaagtctttcccaaatttatcccaacctttaaaaacaaattatcccaacctttttttatcctccttttaattttggcacaacataatgttccacaatggaatataacatcctatggaacgtaccggctggtatatgatatgggctgccctctttccgttaacaaaaaaattaaaagcaagacattttccttcaaatccatactttatttagagagaggcctataaaattcacttgcgaatctgattgactttcttaaaaaaacatactcttcattcattgtattatgccattttgcttatactctttgaagctgtttctacttctgtttccaaatgcatatgtttttttaaagctctgttttagacatttttgtgtgttaattagtagcatctgctccatgtgtcataagacaaagtaatttcatccccacaaaattgtccaaattgcaggttaagtggtagcagcctagctgttgagctgttactactgtttggtatttttaaatggcaaaaaataccttcggtgatgcatcacatgcctttaataaaacacagtcactttgggtaacagaaagatttagaaatggcagtgggttttgttgtatttctttttatgattctttctttccagtgctttagtttccattggttgtgggtacaatcctaagagtcagaccaaaataaagaatattccatcagtatggatcaaaaacatgttcctggccggacatgatgggtcacacctgtaatcccagctacttgggaggctgagctgggaggactgcttgagttgaggagttcgaggttgccgtgagctatgatcacaccactacactccagcctaagtgacagagcaagaccctgtctctaaataaataaataaataaataaataaataaataaaaaattaaaaaacatgctcctggctgctgcgtgatgagcatcatcttcctaagacatgagactgatacttgcaccacccagcaccagtttcttcccggcacagtgccattctaaatttgtattgaggcaggagtgcagcgagaatttctttctccttctgtatttcacatgtctatgccacagaaagaatagaaacatcttaatttgttataataattatagggacaatagtcactgtattttatataattcaaaagttctttttaaaaaattttttggtcttgccggttcctactgaaacacttcgtacagtttgaatccttagtgactttctattgccaactgaaaattgattttttcctatattaaaaaaaaatccagccgggcacggtggctcctgcctgtaatcctagcacttcgggaggccgaggtgggtggatcacctgaggtcaggagttagagaccagcctgaccaacatggtgaaaccccgtctctactaaagattaattagccaggcatggtggtggacgcctgtaatcccagctgcttgggaggctgaggcaggagaatcgcttgaacccgggaggcagaggttgcagcgagccgacattgcaccattgcactacagcctgggcaacaagagcaaaactccatttcaaaaaaaaaaaaaaaaaaaatccaaacagaaaatactgtggctatcttattcagtatcttgttcttttccttaccactgagtagtttcagggaaaaccctttacaattgcaaaaagacattcagtttataggactatttattacagcgttggcaaatggtgctggaaattctctaatagttaaatgacgcaaattaaccagactgaaatggaagaaccatactgaggttgctcttcaaacagcaagaggctacctttctgttttctttgacaactgaatatagcttatgatatagttaaggtatcaaagatgcaagaattgtagagctatgtggcaggttaagaagcctgatgaatggccgggtgcagtggcccacgcctgtaatcccagcactttgggaggccgagaccagcagatcacctgaggtcaagagttcaagaccagcctggccaacatggtgaaatcctgtctctactaaaaatacaaaaaattagctgggcgtggtggcgtgtgcctgtaatcccagctacttgggaggctgaggcaggagaattgcttgaacctgagaggcagaggttgcagtgagctgagaccacaccattgtactccagcctgggcaacaagagcaaaactctatttcaaaaaaaaaaaaaagaagtttgatgaagatgcagatgcttcattgcttgtgcaaattgtgtgattttagcatattctacagtggaaagtcaaatttcaggcatgcacacctaaagtaggaaaaatggttcttaaaggggtagtgtgatgcagggattaagaacctggtttctggagtcagatggcctgagtttgagtcccacctctaccatgtatgtgtgctgttgaacaggtgatttaacttctttggggctcagtttctcccactgtaaaaagtcatgtaaagttcccagaagagtgtttcatacattgtaactgtagtagttatctactgctgtgtaagtaattactccaaatcttagtggcttaaaacaacaagtgtttattatctctcagtttttctaagtgtgaatcactgcatatcatagctgggtgtctctagctccaagtctttcatgaggttgtagtcaagttgttaacctgggctgacgtttcatctgaaggatagggtgggggcggtagggatctgcttccaaatccactcacatagatgctagcaggcctcagtgatatgccatgtgggcccttccacaggactgcatcacagcctggcagtcagcctcccccaggtgagtaacccagaagaggatgcaagatcccaagatggaagccaccatcttcatgtaacccagtcttggaaatgatctcccattacctttgccacagtctgtttgctagaattgagtcactaaatccagtccacactcaagaaggctttacaagggcatgaattccaagaggtgggatcactggaagccatcctgcaggctgcttataacagtaacttgtgctttaatttatatccccttatggtctattcctgacaatcagaccaaatgagcccttaaaatgtaaggcagatcatgatactactgcattaaaaattatctctggtcttcccattttacttaaaagtcggtatctttacaatggcctacaaggcctttcatgcttataaaattatttttctatattttgtaaaataatatatatgtataataaatgctatatatgtatatttgtataaacacatgtttatatgtttagttatatatctagaatttattttccatatggtgtaagatagcaatctctttcgaaacgaagagccaggtttcccagcactatttattgattacaatacccttttcctgggccaggtgcggtggctcacatctgtaatcccagcactttgggaggtcaaagcgggtgaatcacgaggtcaggagttcaagaccagcctggccaacatggtgaaatcccgtctccactaaaaatacaaaaattagctgggtgtggtggtgggcacctatgatcctagctacttgggagcctgaggcaggagaattgcttgaaaccagaaggcagaggttgcagtgagctgagatcactccactgcactccagcctgggtgaaagagcaaaactctgtctcaaaaaaaaaaaaaaaaaaaaaaaaccaaaacaaaataaacctcttttttccctgagttgatattctactgagaacctgtttgtctcttattatgcaatctgtgtctaattgttgcatttttgaataaagatatacttagtgggtctagtaaatcatataagatagttgtgtttgttatgattttatttgatttgaaacattcaaatacatgtaaaaacaaattataattgagaattaattatggcaaacatttaataagttcctttatttgatagattaggaactaattttatttaaaaggccgtgacttacatttaaaagtccaattagctacaacattaagactaaaaagtatatttcatgactcccaggtcactgtttataggttgttgatatcccatactttgctgctgctgctgttgcttataactgttcagaaaattttcaccaaaatgtctatcaaattggaaaaccctctggagtgagatcctttttaaaatatagccaactttcacatatgcaggcatatctgtgaatgccctaggcccctgtgctttctcttctgctttttgggcttttggccttatctttgcttatgataacttcaaatggtaaacaagaagggataggtgacagagattaaacccaagccagtttgttttgttgattattattaacggtattgataaagagtttgctgaaagagggaagcatattgaaattattgcttaaaaagaagtgtgtagaattttcagttgttttcttttgataagagttgcctcatagctgttgtagtatgtgcaaatgaaggtcagcgataaatcacagaatgaatcacttccaactccttcacatctacagatataagtaagaatggaaaatattgtcacttagatgagtccttattttttttttctgtatgaatagtataaaccttacttttctggacacctagctttggcagctggtgaaggttgttaaagtaacaaatgggaccattctgcctctcccagatcgattttgctgcaagatagttgaaaataatataatccagaaatgaatttattttcttatggcaaaaacaaaacagaaagagagtactatgaggaagtatcatgctactggtaaatttttcaaactaaaaccgcattacatttcattaaatgagtttatgtccattaagcgtcaatgagcatgagtggttgaacccagaatccagtcaaagtacatattaactttctgtatgactttaaaaagaggtatgtcaacctccctgggtcagcaggttcctttgcagaagacattggaatgaaacgtcaaggacctcttccaattatagaatacctcgagatatgaagttggtaacaaataagagaaatgcagcaagatatttttagttaaaaaagaaaagattgatacaagccagtaacttgcagtgaacttgtttaaatcctcctcctctctccaaattctgtttttaccaagccggtaaagtaaagacagtttgtcatgctttgaacttcctggcttatgttgatttctatcagtatgttgccttacacatttgagtgggagctgagttacataaaactaataaaatccttacaaccccattttctgtgggtactgatagcatccaaaaaataaaaaaggcttttgccattttcaggcagttgttcctccggctagatggaaaattgaatggcattatctcaactcacatgtttaaacattaacggagagacactttctcctcctcaaaagtttttagtgttcccaggaatttaaccacagatagacacaactcctcaaacgtcccgaaaaaaaggttgactattccataaagtaatagttacagaaggctttcaaggaattagttattcacacagtaagcttctgaggcatacgagcatatcctctttcttacaacttggtcacttgatccaatctttgatgatcaccgtgggacctttggagatttatggagtttagggttacaagtatgatgtggccaccatactcagggaactggatgacagtcagccgatgggttttcaacatagatgaggatgagctcataaaaggctaaaaaaggaggcagacacctttggaagactgtttctaggctctcaaatggccattgtcaaaaaacaaacagtggggtggatttgactaagcatcagaagatgctttaacaacagcctgtgacaagtgagcgttaaaagctcacaaggcagaaaggaacttttcagagtgaccttgtcagacgaggttctaatgtgtaggctttatcagctgctctgagtgggggtaaagaggcatgcatattttaaacattcatttcatattcagtgtgtaaagtaactactgcttttcagcttgggtggagaaagtatttatcaagaatcacacaagggaaacccatgcattacctacttatagggcaaaatggaaaatgttctctctcttatgctttatcttttttgttccatcttaatagctctttatttaaaaagtattcacatcagttgattagtctgagtctttcatttgaagcaaactttcttcactttctgcccttgatactgcacatcagtctttaatcacttagacgtactgaatttttctttattcacatctttcaatcggtaaacttgaaattttgcaagtgcattcccactggtgtacattctgattttcaagacctgctacctcccccagtgtcatgcttgttttttttttctttctttcttccttcccacaccccacctccagtattttagggcaccttatgtagataagcagtgagatggcttcatcctgataattaacatgcttgtttgaggttatgaaatatacatttgagaaaggccagggatttccccctgaatatccactaactgcttgaagtggcattttcattctgacttggtattttgttttgtttgactgcagcatactggagcatagtgaaagagtctattttgaagcttcaaacttagtgctgctgcagaccaggaacaagagagaaagagtggatttcagcctgcacggatggtcttgaaacacaaatggtttttggtaagtcatccaaaagacttgacatcttttagctttaaatgtcatcgggcatcacttcactggtgtaccagaacttcttcttcaagcgtattgctatttctctacatcctaaataacaggacatttgaaaaaatgttgtcctagtgacagagcactgagagagcaaccgcatttactttatgtgtttgtttctgaaacttgcagaatagtatgatctgaatagaatgtatttgtggttagaaaaaagaacaaaagcaaaaacaaagcaaacccaaacaactaaacacacaaacagcaaataaactacatctaccagatactccattttagctgaaaacataagggattaatcgcacgagaggaagtagattcaatttaatggcaagttttttgcgtcttgtgatcaaatacagtcatgtgccacataatgaagtttcagtcaacgacagatcacacgtattacagtggtcccataagattataatactgggctgggtgtggtggctcacgcctgtaatcccagcactttgggaggccgaggcgcgcggatcacgaggtcaggagattgagatcatcctggctaacgcggtgaaaccctgtctctactaagaatacaaaaaaaaaattagccgggtgtagtggcgggcgcttgtagtcccagctacttgggaggctgaggcagcagaatggcgtgaacctgggaggcagagcttgcagtgagccgagattgcaccactgcactccagcctgggcgacagagcgagactccatctcaaaaaaaaaaaaaaaaaaaagattataatactgtattttggttgtaccttttctatgtttagatgtgtttagaggcacaaatgcctaccattgtgttacagttgcctacagtattcactacagtagcatgccgtccaggtttgtagcctaggagcaataagctataccgtatagcgcaggcgtgtagtagggtgtaccatccaggcctgtgaaagtactctgtgatgttgcacagtgacaaagtcacctaacaatgcatttctcagagcatatccctgtcattaaatgatgcatgactattgtgatgggcaaggtgaaagatgatgggggtttccaagtcctgttcagcaaacatttactgagtaacttttaagtatacatgggcccttgaatgacagtcttagtctgggggttggaattcaaacactctaaactataaataaatgataaaaccattccagagcatacaccaacataatgtggacttccaggaattttttttttatcaaccccgttcatgatattacctggaagcagagtcctcaaattgaagcctaggtctgccccacctatcttggtcaccttggagaacttgctcatcatcttggaacgacttgcctttaaagatgtatgtgcctaactgatctccaaggtctcctgcaaatttataattcagttccctctagtgcaatgaattaaataattatccacttcagttcttgcccaacagaatttctgtgtaggcttggtggtcatttgcagaggggctcattgtatcaaccagtgtggaggaaaggagccaggtcctcggggggtccctcctggccccatttgcccatttgacagccagccctttggtcaaacaggactgtcagcatctgcagtaaataatttttttgttttttttttttttgagatggagtcttgctctgtcaccaggctggagtgcagtggcacagtctcagttcactgcaacctccacctcccaggttcaagcgattctcctgcctcaacctcccgagtagctgggactacagatgcgtgccaccatgcccagctaatttttgtatttttagtagagctggggtttcaccatgttagccaggatggtctcgatctcctcacctcaggtgatccgcctgcctcagcctcccaaagtgctgggattacagatgtgaaccactgcacccggcccgcagtaaataatttattcccttgcaacattaaaaaaaaatgtggcacagtgctttatgaatattatattcatttttatgtatttaattttaatttatttatttatttatttatttgagacggggtttctttctctttgttgcccaggctggactgcagtggtgcaatcgtagcttgtgctgggaccatatgagactgggactatcctggctgtcattcataaagtcttcactgaatttttaggacttcgctgactggtctctctttatgaacttctgtcacatttagggcctgcatcatataaaatgcactgctatgtgttgttctgttagtgtttgtcatcacgccatcaggggtacacacagcttcagggcaggaatcatcatcacagaccagtagccgagactacaggcacgcgccaccatgcctggctaatttttccatttttttgtagatacgaggtctcgctatgttgtccagactggtctggaactcctgggctccagcaatcatcctgccttggcctctcaaagtgctgggattacaggcatgcaccactgtgcctggcctgaatattatatccaaataagtgagataggcttcttttgaaatactgtcctttgtttttctttaggggatctgactttttccttctctgtgcttgccgtcattgtgttactggttaccggccagcctgttaaccctgtggatccccacactttgttttacgttgaatagcatttattattgttctttcttactaaacatcccctttctgaagcagagcttcagaaatgatgctcagatgtcactcttgttagcagctggctttctgccttcaagtgatgcattattggggtttcataacagcatttttttttctcttacaaatattaaattatgaagtgcaggaaaccacatgaatgtggtagaaagcaaatgcaaacacagtgttatctggaagtgctagttttgtgattctcctggtgacagtatccttcctgtaatcaacataggaaccctctttacctgtttgctggtggttttctatcctgtatcttcctctccatttatgctgtatgccatggccactttgtcatgctgaatcgggaggtttgattaagacagttgcttggggactatctctatcaaagttctgcctcaccacaaatcctggctgtcacttacaaagtcttccctgaatcctcaggacttcactgactggtctctctctctctctctttttttttttttttttttttttttaaggcagagtcttgggtctgttgctaggctggagtgcagtggcaatcttggctcactgcaaccttcgcctcccaggttcaagcaattctcttgcctcagcctcctgagtagctgggattacaggcatgcgccaccgtgcccagctaatttttctatttttagtagaaatggggtttcaccatgttggccaggatggtcttgatctcttgatctcatgatccatctgccttggccttccaaagtgctgagattacaggtgtaagccactgcgcccggccctgagcagtctctctttatgaacttctatcacatttagggcctgcttcttacagaatgtactgctgtgcattactctgtgagtgtttgccatcagcacaattgcacatgggttgcacatggcttcaaggcaggaatcaaatcacagaccagtgtttcccaagggtggtctaatcccagtacctcctgcttccgaatctcttggatatgtttattaaagttgcagattcagcaacaccaggcttatgaatcagaagttctggggatgtagaacccaggaaactcaccttagttaacttttgcacactgaggtttgagaataactatctgaaaataattgtgcatcctcctctttgcctcctctcccacagcaaagggtccaggtctgagcctatggtaggtgtccaggaaatatttgcttgttgacctaagcaacatcaagccatgagggttgcattccctcttcagttgccaagctttttcaggatgtgaggtcagcatattctctgaacctttagaaacccactttcttccaaatacgtaaagtgttcccctagggcagaggctcttttggaaatctttttttgtctctttatcttttgtaatcactaactctgttggtggtaatgacaggagcccctgactaagattgggatagtggggacatcagctatgaggagctgggctggagcagcaggctaggagaaagatctgaggataggaaccggactgtgctaaactagaagctttatccttggctcccaaagccacacctgctacccttggcagtttattctgagtggtatttctttcagctgttaggcctcgcaggttgtcagttttggtggcagaagagcggtcccgctgctgaaaaggatcaagtttagctctagtggacgcacatcaaagcacctacagtgcacagtggtggattcaggatttgaatccaatgttagcagactgcagtggtgacacttggccctctccttccgtccgcctcttgttccagcaagggcatgcctggtcttggatgatccaggagagatttgcagggcgttgctgcttctggtgcacctcctgaatgcccttgctggtggctccagccctggtagatggaatccaaacagaagaactcacagaagcttagctagcctagaaaggaaccagcgtggccatcaggacatttattagctgttaatctaaccactaccaaatgcattaacacattttttttgacaactttttctcttttatttggctgttgcttagttcagttttgcttggagaagttgtggcaatcctgaattcagtttgtgtgaaaaagcaagcaccttcaagcccagtgttggagaagtatcttctcccaggtctctattcagttttgactaaaggaggtttggcgagcagaaaggtattaccgagtggattcttctcaaattctcatctaagtgaaggaaaaaagcccagtttgctgaagccatgttaagggcacattaggcttttaatatgtgcttcatggagaccttactagattttcctctgcgtagttctttccatctgatgggagcgagggctgtttttgggttgcagaaggcaagagccaggttgtcagctacagaagagaaaggtgccattgtctgcataattgactttgagcctttgtctaaaaggatgtcaggtggaggagtaatgaggggcgagatttttaaaaaattatagagtacaggattttagcaaaatgccagatgttggcatttctgttttggaggtctttagtggtccatgtaaactatttccttgcaagtaaccatccatggtaggaaaacagaaaaaaatgattctaaaagagcatttgtctagttagaaactgtgtcacttgtatcgtttaccgtgaggcatccttgagaggtacatgatttccaaacagccacctaaatcataggtactgcttttggaacagatgtaaataggaaaagcgccagtccagtacccccactaaagaccatcgttagaaagctctcgcagtgctttccagcttagaggagtgtagttcccttcaggtacttaagccagtgttcggtaaagcagcacccaaaatgccttttgttaaatgtgttctaactcgttcctcttgctgatgctatcacaggctaatgattgtctaagtccttcagagaagctgtgtggttttgtatagctgtgagtaaaaccacacccattcaggaaatgcaatgtactttcttctaacaggcatcatcaaaacagatgctgatttacatggtaggtccccttctttagtgacaatttgagagctttgaagggaggcatttgccgtgcatcagaagaaatcagaattaaactggcacacgtgcacattgttggagtaaaaaggaaaagcagtgacctagagtttgttaccgcacatgctttccctgaaggcatctgcaccatcatgatgtcctcatcaactctgcacacacaactagtatttctgtctctttctcttcagagtttaagctcaatgatttccaacttcctcccacatgactccagctggatatcacataggtgtcttcaatttgaatctaaacctgactttgtcattgtcctacgtttatgggctccagggtcactagctcaccatttgttgatgctggacacctcctcttcctctgcttcatccctagctcatatgctggagttctgccttttttttttttttgagacagagtctctctctgtcacccacgctggagtgcagtggcaccatctcagcttactgcaacctctgcttcccaggttcaagggattctcctgcctcagcctcctgagtagcttggattacaggtgcgcaccaccacacctggctaattttttgtatttttggtagagatggggtttcaccatgttggtcaggttggtctcaaactcctgacctcatgatccgcctgcctaagcctcccaaagtgttgggattacaggcgtgagccactgcccccagtctgagtttggcctctttaatatgatagtttacccactcttctccactctcgggcccctgttctgttgcagaccttcagcatcacttgcctggactgctgcagtggcttccaagaagccccttgcttaaagtcttttctttctgtgttccatttattctactcttttgagaattctcatatgaaagaaagggtctgattgaattactcctacacttgaaaatccttggtagtatgtggaaatatggaaaagtactcataatctaatgtgttaaaagaaaaactttagacaaattaaatttaacagagtttaattcagcaaagaactatttgcaaatcaggcagctcctctctactcctttcctcccgaactagaatagattcagggcatttctgacatgctgttgtgtggttggagaggatttatagacagaaaaaggaaaacgacggacagaaaacagaagtgaggtacagaaacagccagattggtttcagctcagcgttcgccttatttgaacagggtttgaacgataggctgcctgtgattcgccgaaacccagagattggtacaagaataggttacagcctgtttacacatccaggtaggttacggttcactgcatgcggagaaacctttaggccaaacttaaaatatggaagaaggcagctttcggctaaacccaacaaatgttaagtataaaattcatatttcaaaattgtgcaaacacattgattacaaagcagtgacaaaaatctatgcctatccacaaaggctagaagtaaagaaaacaagaatgaaggtatttttaatattagggcaattcatgtgtgtgtgtgttttttaatactcctttggtagcaaatgaatatggtgaagtaaaatgaataattgaaaggattttgttagctttctgctcctgataaggtaaaatgtgaatttcactgcatggcctctaaggcccctaggaattccttatcaacttaccatttaaatctcatctcccgtgactcccatcccttccatctctccatataatatttgttttcttcttaaacatactatgtatataataaccatgcacctgtccctgttgtttcttctcgcatgagactcttgttctctgcctggtaaactcccactcattcgttgaggcctaattgaaattcctggccaagcatggtgtctcacatctgtaatgtcagcattttgagaggctgagggaagaggatttcttgagcccagaaagtttagactgcaccattccactccagcctgggcaacagatagagagctcgtctcaaggaaaaaaaaaaacaaaacagaaattatcctcttgctgtgttaccgctattatattgcaattttctgctcatatagctatcttggtaaatgattcatgaagacagaaattgacttatcttaaaccttgtattccaagtgttaagcccattcctgcatataatacagtttaataaatatttacaaaggtaagaagaaaggaaagagcccatttagaaatacagaaataatccttcaggtaagatattaaaaatgtttttggataagcttagtactaattactatttcataaaaattacaaaaatagatgtttttggttaaacagtttttacagtaatagttggattcagcctcacatcatttaaactaaactactggcgtatatctttggcattagaaaattctaacatcagatagaattgcttcagcttcactgtaagccatatttatgaagttactaaaaaccatttttttaaactgttttatgtcatgcataaccatgtcggccaaatcagaaatccaaataaatgacacatccagttctggccacattttgtgaatatctggtatttttttcttaagggaatttaaaaagactgggtaacattaaagggttgatgtaacattttcaattctgaaaggctactctgctctaggaatatacttgttactattttttttttcatttctaagaattctgtttggctaaaataccaaaagagaaaaaaataacttggcttaaataaaatgaaaagtcatctccaaaattaattcggctcctcaaaagttctttccaaaggaaggaataggatgctatttaatattacatgtcaaaaacaccactaaaaagaaaatcatcatttgtacgtgtgacaaggaattcagaatggaattttatgaaggctagtgtgtgaggcacgctgctcacatcttttaaaataatattttgatatcggggaagattatttaatactatatattattttatattatatatgtatgcatatgtgtatatacatatataaaatagagttttttcctattaatgctttagagtcaataagttgtaatggggaatttcagtttgagatttgtcattttttttgcatgatagccttgcccagccttcagttttcttgtttataaagtcatgccaaaaggtgaactgtcactggattaactaattaagaaattagtcagtcactaacatttattgattgaccactgattggaaacattaaatacccacatcattttttagcatttcatgtaagttgatccttgtctgttttgcagagtaaagaaccttagctgaatttcatttttgtctgtcctgatctttgcattcatttaaaaacctgacccttcagctgtttacaagatccatcatgaaatataccatggctaaggtgaatgtgcagactcccagtttccctttagctattctgttgcactagccatggggttgcaaacttttttggtgactgttacagttcattcatcaggaggtactgactatattttgttgcactttcatgagagccagggctcagaagcatcctaagtacctagtgacaaaaactcaggaaggcaattagactatgacgcttttcattacaacctaaggtgcctctcaatatagtaggtgcttatgttgaactgccctctgcagactgtatgtgtgggtccatgtggtgatattgtggctgtaccctctccaaggttgcctagtgttggctgtagcaggaaaggaagtgtctgtaagcaatagtagcttcaatgaggaaggatataaaagagaagtgaactagtcctgaaatcttaaggatctacatacagaccagagtaccttgatggatcccaaagttttattttattttattttgtttttgagatggagtttcgttcttgttgcccaggctggagtgcaatagcgcaatttcggctcactgcagcctccgcctcctgggttcaagagatcttctgcctcagcctcccaagtagctgggattacaggcacctgccactacacccagataatttttgtatttttagtagagagggggtctcaccgtattggccaggatggcctcaaactcctgacctcagatgatccacccgtctcagcctcccaaagtgctgggattacaggcgtgagccactgcgcccggccttattttatttttccagcattattgagttatgattgacaaaatttgtgtacaacacgatgctttgatatacatatatattgtgaaatgtttattatcatcaagttagttaacactttcatcacctcacatagttattttttcttgcatggtgagaacatttaagatttactgtctcagcaaatttcaagtgtacaaatatcattattaaccatagtcactgtgctgtatattcaatccccagatctcaaagatttaaaatctagccctgagacaactgattacagccaccatatgttttcttaggtagttcacaataaatagttataatgctgctgagaaacagtatgatgtgttgaaaagtgtaggttcttgaggcaaacttcctgggtttgaataccgaacttccacttaatggctgtgtaatgttgagcaagtgacttaatctctttgggtctcagtttatcaatccatgaaataagaaaaataaaacaggccaggcacggtggctcacgcctgtaatcccagcactttgggaggccatggtgggtggatcacaaggtcaggggttaagaccaccctggccaatatggtgaaaccccatctctactaaaaatataaaaattagccgggcgtggtggcaggtgcctgtagtcccagctacttgggcgtctgagacaggagaattgcttgaacctgggaggtggaggttgcagtgagccgagatggtgccactgcattccagcctgggtgacagagcgagacttcttctcaaaaaaaacaaaacaaacaaacaaacaaacaaaaaaacctaaatgagtcttgatgcacgtaaagctttcaaaaaatggtagctgttattatcataccactttcatggaatttcgttagttactcagtttgtggtaaaatttttccagtgtttattcttcatgccttcctacaaacttggtttaggaatttacactgttaggggaaacatgtaggtgaacccagctagggaaggcgaagcaatgctgtgggaacacaaaggagtgggatatttagtctgatttgggagtggtgaggacttggaggaagcatcagagctgacttggaagaatggctaggattccacctgacagagctgggagcaaggcattccacacgggagggcgtgtgcccaaaggtgtggagaagggagagtgcagagcagagcatatttgaggaaagctgtggaccagtttgagcccagggttaaggtgtgtgaggtggaacagtgggagactgggaggaagatagtctgatttaatgataatgatgataacggtgagtgtgaactattcactgagtggtgccatatatcagattctgtggttggggctttacataaattagctctgattacaactcccttcaacatagctatccacattttacagatgagaaaatgggattaattccattttttcttaagtggcggagagccactgaaggttgttgaataggagagggtcatgatcactcttagcaggaatttacttatctgctttttcacttccctggagtggtagacacgtcttttgttttgtttaagagacagagtcttgctctgtcacccaggctgagtacagtggtatcatcatagctcactgcatccttgacctcctgagcccaggtgatcctcccaccccaacttcccagagctctggaattagaggcatgtgccaccacacctggctcatttttaattttttttttgtagagatggattcttgctatgttacccaggctgttctggagccctgtgttccagcaattctcctgctttggcctctcagagtgctgggattatgggcatgtgccaccacacatagccttggagatacatcttgcaccatcctgggctccccagaggagtggtattagactgtcagtatggtgaatactccataaatactggtggagtctgttttcaaagcttccttaacaaaactctggaaacatgttttgtacaatttcctttttaaagaagaaataaactggttaagttactgagcaactcctttttgcctgtgcatgtttcatctcatttgatccccataggaaatcttaaaggtagagagtgtaatttttgcatttcaattatatgttattaatattataatggatgaggtcactgggactgaagaaagtaatgctgcttggagatggtaaagctgggattcaatctgtggctccctcacccttggtctgtagtcggccaccacccctccctctattgaacctctcttttattgctgttttccagtctccactaagtatttcttccactggtttaagtccacgttgctaagcaagtacacagttgcttttaaggaaacgaaagccccacaaggacccagtctactttgcagaggttaaatggaaatagattattttcaataatctgtcctcaggaccagaattcttctaaatgatgctgctggcagctggccatctctgggagcccatcagacaaaccacttgtaggagcccagcatcctgcattgggtcagaatgcaaagtcaactaactcttcacagtagatgcagtttgggcgtgagtacctagcaggaaccctagatatttggggcaagcactttgcttcttccatctggtggaacccacgtttattatctaaaagacacatggcaacaggcaatgcagtgtttgcttccaaagacagcctggaatttggaatgacatttagtgaaaggggaaagttcaatttcagctatcaaaggtcatggccagtgaacctacaagcacatattatgtaaatttggcccaaatctgtatttattagcttgaacagttttggagtggttatctgctctacaaaaatgatctaccgttaagagtctcaaaaatatcaagtctgcttgatgcatttaaatcaggaagcgtaaatatttggcatccatgctagtgctgattttcagaggctttgctcacctgcagctgtgctcactttgcgaaaatggacatggtgacctctactttcctggtgagtggccacgtcagtatcatcccttcccgttcctggcaccactctcacccactttggagagccagcatagagcagcacgctgtgtctcagggaccaggctatccatcagataccctactctgaaagtgtccttaatttgatttttaaaatatatataaatatatagtgtgtgtgtatacacacacacacacacacacacaccataaaatttaccataaatttaccattttaacctttttttttttttttttgaaacggagtcttgctctgtcgccaggctggagtgcagtggcatgatctcagctcactgcagcctccgcctcctgggttcaagcaattctcctgcctcggcctcccgagtagctgggactacaggcgcatgccgccacgcccagggaatttttgtatttttagtagagatggggtttcaccatgttggccaggatggtctcgatctcttgacctcgtgatctgcccgcctcagcctcccaaagtgctggggcgtgagccaccacacctggcccagtttaaccatttttaagtgtacaattcagtggcattatgtacatttccagtgtagtgcaatcatctccactatccatttccagaactttttcatcatcccgaacagaagctctgcattcattagacaataacactccattctctcctcccagcccctggtaacctctattgtacactgtgtctctatgaagtttcttattttagggaccacatggaatcatacaatatttgtccttttatgtctggcccataatttaatttttaataacagtgtttcaaatatactgttcttttccaaagtatttgttatcaatactttattatgtcagtaattatcaataagttctcattctaatttcagaaactgggttgtattggaatatgggcatagagaagatacagatttttttttcttcttaataactgaagagaataacatttatcaaacaaacgatcgaactctttctgagacatagtttcatgtgcctctttggagttgatttcccctcactttattttaactcctatttggcccgaattcttctcagaatttctgcaagcaggctcatagtcctgcgttcttctcttctctttttttttttttttttttttggcagggtctcactcttgtctcccaggctggagtgcagtggtgcaatctcagctcactgcagcctcgacctccgggcctcaagtgatcttcctgcctcagcctcccaagtagctgagattacatgtgtgcacgacaacacctggctaatttttgtattttttgtagagacgaggtttcatcatgttgcccaggcttgtcttaaactcctgggctcaagcagtctacccgtcttggcctctcaaagtgctggaattacaggcgtgagccaccgcagctggccaggcttacatttctgtagtgcctgttaggaagagttcagaattttttagacacaggcatagctcagagatattgtgtcttttttttttttttttgagttgggagtcttgctttgttgccaggctggagtgcagtggcacgatctctgctcactgcaagctccgcctcctgggttcaagcctcccaagtagctgggactataggtgcctgccaccatgcccagctaatttttgtatttttagtagagatggggtttcaccatattggtgaggctggtctcgaactcctgaccccaggtgatccacccacctcagcctcccaaagtgctgggattacaggcatgagccactgtgcctggacactcagagatattttgggttcacttatagaccacagcagtaaagcaagtattgcaatacagcaaatcacacaaattttttggttttccagtgcatataagttatgtttacaccatactatagtctattaattatccaataacattttgtctaaacaaaagtacataccttaattttaaaatgctttattgctaaaaactgttaacgatcatcttcattgaaccataatcgttttgttggtaaagggtctttacgttgatggctgctgactgatttagggaggtggttgctgaaagctggggtggcggtggcaatttcttaaaattagacaacaatgacgtttgccacatttattgactcttcctttcatgaaagatttctctgtagtatgcaccattgtttgagagcattttacccatagtagaactttcaaagttagagtcagtcctctcaaacctgtcactgcatcaattaagtttatgtaatatttcaaatcctttgttgtcattttaacagtgttcacagtatcttcatcaggagtagattacatctcatgaaaccactggtttttttgtttgtttgtttgtttgttttgagacggagtctcgttctgtcacccaggctggagtgcagtggcgcgatctcggctcactgcaacctccacctcccaggttcaaacaattctcctgcctcagcctcctgagtagctgggactacaggtgcgcaccaccacgctgggctaattttttgtatttttagtagagatgggtttcacaatgttagctgtgttagccaggatggcctctatctccggaccttgtgattcccctgcctcggcctcccaaagtgctgagattacaagcgtgagccactgtgcccggccatgaaaccactttctttgctcctccatagaggcaactcctcatctgctgaagtttgatcatgagattgcagcaatcaattcagtcacattttcaggctccatttctaattctggttctcttgctgtttccacctcatctgcagttccttcctccaccgaagtcttgaaaccctcaagtcatccatgggggttggaatcaacttcttccaaactgatgttcatgttgatattttgacctcttcccatgaatcaaatgttcttaatgacatctacaatggtgaatcctttccaggaggttttcaatttacttttcccagatccatcagaggaattactttctgtggcaatgatagccttacagaatgtatttcttaaataagaagacttgaaaataaaaattactccttgatccatgggttgcagaatgggtgttgtgttagcaggcgtgaaaacgacatgaatctccttgtatatttccatcagagctcttagatgagtgacgaagtgcattgtcaataagcagtaatattttgaaaggaatctttttctgagcaattaagtctcaacagtgggcttaaagtatttagtaacccaatgtgctttcatccaggctttgttgttccatttctatagcactggcagagtagattcagcataattattagggctctaggatttttggaatggtaaatgagcattggcttcaactaaagtcactagctgcatttgcccgtaacaagagagtcagcctctcctttgaagctttgtagtcaagcattgacttctcctctctagctatgaaagtcttaaatggcattttcttccaatagaaggctgctttgcctacgttgaaaaatctgtagtcaccttcatcaatgatcttagttaaattttctggataacctgctgcagcttctacatcagcatttggagaagatttctttccttaaatctcacgaaccaacttctgctagcttcaaacttttcttctccaagttcctcacctctctcagccttcatagaagtgaagagagttagggccttgatctggattaggctttggcttaagggaatgtatggctggtttgcttttctattcagaccactctaactttgtccatatcagcaacaaggctgtttcactttcttaccattgatgagttcactggagtagcacttttaattttcttcaagaacttttccttagcattcacagcttggctaacccttcagtcacaagaagcctggcttttgacatatgtcagctttcaacatgccttcctcgctaagcttaatcatttctagttttcttatttaaattgagaggtatgtgactcactcttcctttcacttgaatgcttagcggctattttagggttattaattggcctaatttcaatattcttttttttttttcttttttgagacagagtctcgctctgtcacccaggcttgagtgcagtggcacgatctctgcttactgcaagctccgcctcccgggttcacgccattctcctgcctcagcctcccgaatagctgagactacaggcacccgccactacgtccggctaactttttgtatttttagtagagattgagtttcaccatgttagccaggatggtcttgatctcctgaactcgtgatctgcccaccttggcctcccaaagtgctgggattacaggcgtgagcccccgtgcctggccaacttcaatattcttgtgtctgaggaaacaaggaggcccgagaggagggagagagaacagccagtctttgtagcagtcagaacacacatgacatttactgattaagttcattaccttatatggggtgtgtggttcatggtgaacaaaacaattataatagtaacgtcaaagagcactgatctcagatcaccataacagatataacagcgcaaaagtttgaaatactgtattaccgaaatgtggcagaggctcaacatgagcacatgctgttggagaggtgatgctggtggagttgcttgacacggggttgccacagaacttcaatttgaaaaaaaaatgcagtatctgcaaaggacaacaaagtgaaatgcaataaaatgagatgcgcctgttgcatctttcaactgatgtgtcctttcttttcattaaaaaaaaataacgttctgtccatctgcctctgtccaacaacaggcagtcacatgtgatgcctactgttggagaattggtgaatcataggcctccacttctggtgctattactcagagaagaagtatttctttctgcatagaaggaaacattgtaattttactgcagcaatgaaattgtagtagaggtgaacataattcttctatttacatctttaatgagccacaattaaaagtagtgagttggcatgtcagagtgaatgtgttattttcagatttctgttagaacaatggctgctgctggttgaagctgcacttccctggccccttggagctccaaaagccttaagaaagaaacccaggggccgggcgcaatggctcaggcctgtaatcccagcaccttgggaagctgaggcaggcgaatcacctgaggttgggagttcaagaaccagcctgaccaacatggagaaaccccatctctactaaaaatacaaaattagccgggtgtggtggggcatgcctgtaatcccagctacttaggcggctgaggcaggagaatcgcttgaacctaggaggtggaggttgcggtgagcctgtgtctggagttggttccttccgataggtttgtggtcttgctgacttcaagaatggagccacggaccttcacagtgagtgttacagctcttaaagatggtagggacccaaagagcgagcagtagcaagatttattgtgaggagcgaaagaacaaaccttccacagcgtggaaggggacccgagcgggttgtctctgctggctggcgtggccagcttttattcccttatttgtccctgcccatgtcctgctgattggtccattctacagagcactgattggtccattttacagagtgctgattggtccattttacaaacctcaagctagctacagagcgctgattggtgtgtttttacagagcactcattggtgcattttacaatccccttgtaagacagaaaagttctccaagtccccactcgacccaagaagtccagctggcttcacctctcaataccacttctgcatttaattatagccaccgactagctgcactatgatattaatctgggctacttgcttaggaacctgcagatgggtttccataagctagacattgctgcctgataaatgactgtgggatacaggttttcctgatgaggtagtaaagccacatattggaattcatttaacagctcgacaacataatttgtaaacatttctatttagtcacgtgtactcagcaaaaatgtatactaaagtgtttaccatatacttggcattgaagggaattataatgaaatatgttgatcttggtcatttataggtgttcccaccactgtgatgtgtgcatgcattgtgggccaggaggttttatctggaagctagtgacacttcagcgtcaaggcgtctcgctcctgcaggccctttgtaagaccctgtacctaattttatgttgataattttgtgcagtttttttttttttttttttttttgaggcagcgtctagctctgtcatccaggctggattgcagtgttgtgatcttggctcactgcagcctcaacctcccaggctcaagtgatcctcccacctgagccttctgagtagctgtgagcagatacatatgccaccatgctcagctaatttttgtatttttttgtagagatgggggtctcactatgttgcccagttttgtcttgaactcctgggctcaagcgatcctccacttcagcctcccaaagttctgggattacaggcgtgagtgaccatggctggcctttgagatcttttcttaaagaccctaacaccccatacacactcctctaccccttgactagttttataaactgcagacctcacagactggatccacccctgattatgaatatgtttaaactgtgcatatgtatgcattaattaaaacatatttatttctctttcatactagtatgtgaaattccaaaaaatctgctagcccacaaattaggaaaattaaagggctatgcctacctctgccagctgtttccaaggaaatttatatcttggacatttggcagataataatatcatgtttgactgatagtgatcatgtcctaaatttcccaaactgatgagtcacaatcgtgattcacatatttctgggaatcgccccccaacaacttgcgatttgcctggcgtagctgtagtatatcagagttttttaggtgtttagcagaactgaactatatagcttcttgtcccatgccaattcaagaaaattaatttaatagctattttatgaaacattttttcctaactcgacatggatattttaaggtgattttccctgctaagaattcacttgttataggtgactctaattggagaaacagctgttgacttctagtgtgctcaattagtttctttcttcctttttctttttttattttattttatttattttttattatactttaagttctagggtacatgtgcacaatgtgcaggtttgttacatatgtatacatgtatcatgttggtgtgctgcacccattaactcatcatttacattaggtatatctcctaaagctttccctcccccctccccccactccatgacaggccccggtgtgcgatgttccccttcctgtgaccaagtgttctcattgttcaattcccacctatgagtgagaacatgcggtgtttggttttttgtccttgcgataatttgctgagaatgatggtttccagcttcatccatgtcccaacaaaggacatgaactcatccttttttatggctacatagtattccatggtgtatatgtgccacattttcttaatccagtctatcattgatggacatttgggttggttccaagtctttgctattgtgaatagtgccgcaataaacatacgtgcgcatgtgcctttatagcagcatgatttataatcctttgggtatatccccagtaatgggatggctgggtcaaatggtatttctagttctagatccttgaggaatcgccacactgtcttccacaatggttgaactagtttgcaggcccaccaacagtgtaaaagtgttcctatttctccactttcttcctttttcaaagagttcctttattattcccaggccgtcgttaggtgtaaaagctaatttagtttagattattttttaaagtgcacctggcattcaagctatgacatttcctgttgaaacagcactgctatgacctgggaagaaaagatcccaagaaaatataactgaggaatcaaatatttgtctgtataaaaggtttcatattaattcatgataccatttattagtcacttaccttttatgttagtagccataaggaggtgtgatggcatagactattcagggcgaatgacagttgtcatgggcagaaggtgcccatgcatcaggcagagcagggtgaccacaaagtggggagtggccaaatatactttgtcctactcaagacatgagggcctgtcccagtggcttgcttgagaacaaagctcatcctgatgactcagcagccacagtgaagggctgcctgggggctgggggagaaacaagtaggcagatgaggtccagttggaaactaaattgctttgggaggaggagagtggtcacacaatgtaggtttcagttccggctgcactgctaattttgtaaccttgggaaagttaccaacctctctggaatctcagtttcctcccctatgaagaagaaagcagtagcccagatcatccttggaggttccttcccttcagctgtgacattttgcatttgaaagagtaagagaagtcacaggaccatgggaaaggaaaacagaaatgatgtaagggaggcaggtcatggggagggtggtcaggaacacaggttggaagtgcccgtggtgtcaattcaggtgttcggtgatctccacgggcgagtgacttttattgggagaactgtgcactgcctgaggttagggttgtgctctggggaaaccggaaccttgaaaacaccttgtagggagccgcgtttcccttgcacggactgtgctgcctgtgcttccccagcacagtgggcgtcgtcgctttgtgtttgtgctggctgctgtgcggggttgcctgcctccccagcccacacctgctcagccttcctccactcatgttttcaggatgcttttggatgcttctggctacagtggattttccttctccttctgaagcccttttgaaattatttctctgcagattcagacatatttatttatctggtcaatgtcctgcctaaagaatcagataacgactgtgtttttgcctgaactcacacatatgaatgagcttttgtaagcggcagcagcagtgtaggtttagttggagctgtctgagcccttgtcaggttgctacttagttgtttagttagctctcgttgaacttctgtcacatcctcagtttctgggcagtgtgtaagaagagctccttctctctagaccagtggtccctaacctttttggcaccagggactggtttcatggaagacagtttttccacagactagggtggagcgggggatggttttgggatgattcaaatgcatttatattcattgtgcactttatttatattattatgttgtaatatataatgaaataattatgcaactcaccataatgtagaatcagtgagatccttgagcttgttttcctgcaacaaaacggtcccatctaggggtgatgggagacagtgacagatcatcaggcattagattctcataaagagggtgcaacctacatccctcacatgtgcagttcacaatagggttcacgctcctatgagaatctcatgccgttgctgacctgacaggaggcagagctcaggtggtaatttgaacaatggggagtggctgtaaatacagatgaagctttgctcattcgcctactgctcacctcctgttgtgcaggaggtctgtagcccaggggttgggaacccctgctctagagcttaataatcaactggtggagaccagtgcaattgtaaacaaaagtgacaaaacgatagtaataatgccaatggtaatgaaagctacagacattttcagagtgctgtgtctccaagtactgagctgagcactctgcactcatgaaatatgtatcctcctcacacacacacacgcaaaataaatgtttaatggaatattgatcaggaaaaaaacaaccagtaagcaaagtattaatacatgctacaacatagatgaacctcaaaacatcatgtgaattgagagaccacatacttcaatttcatttatatgaaaggtccagaatagacaaatccatagagacagaagttagtttgggggttgcagaggccggaggtgggagaggaatgcagagtgactgctaatgtacacagggtttcttttttggagaagaaaatctaaaattagattgtgatgttggttttacaaaacagtgactatactaaaaaacatttgagttatacacttgagttatatgtaaattaaatcttaataaagctgtttttttaaaaataaatgtttaattctcagaaacaaccctatgaggtagggagtattatcctcctacagatgagaaaaccgaggcccagaaaagaggagaacctgctcaagattacatataaggcatatgtaggattaactttttcattacagagaaatccatggtagtgcttgctaagtaaatgctaaatctattgattgcatggatgccagaactagatggggttagtttagatggattaagggaggaagtggtttaaactgtgttttctaagaagaaagagtagtgattgtataaagaagacaaaagggcatttcaagctggagataattgcttgtgagagttaaacatcaagaaaccagacatctaataggtttgttcaactggagtgaagaatagcctttcatatgacaggtaggtaatcagaagcaagtgaatttagagttatattgttagctgtagtgcgggcttgctgtaattagtagcaggccgacaccttgtaacatctctctggagtgtaaagacatatttctaacagaaatgtgttagtctgcaaagcaaataaggtgcaagcgtaaatgtcctttttccttggactgtctttaccgaatgacatgagcttcacacccttgccttgagctgtcactatcattgcttcactttctattaattagctcggagccttggttctatagtcaacttgaaactgctctggacatatttgctctaatcctcctggacaacctgtgagatgtgccttttcctacacttctgccttgccctggcagccacatgacacactctcgcaaggcaggaacctcagggaggggaggtggcggtgtctgttggcaagtactcagctccctttgaggctgcagatagtaggcattggttaagagtttaaacttgggcaagaactggaagcaaattgggaggacctggaattgtgggtgcttggggaaaaacattacaatgaggactcatatgggtcgtgtggtcatgtttgtttcaagggctttcccttccaaaactggaaaagaaaactgataaaacaaacattgggtggcatttttttctaggcttgtcaatgggtgacttgtttgccgaattaattaaataattaattaattaccttgtttataatcttccttgttttgaaaagatttatggcagtgccttaaatctgtaaatctacccaacaagagaatcttatgaagtaaacaagttaacaggtgaaacatgcctccttttaaatgtttctttataacaaaatgaccatatatcaataacagactgtaacaatgcgtagcaaatgtatttatgtttctcatctattttccactttcaaaaatgtgcttttcccttaaactccaaattgtcttaacaatttcacattttcatttctttcttttcttttttttttttttgaggcggagttttgctcttgttgcccaggctagagagcaatgacgtgatcttggctcactgcaacctccacctcccaggttcaagcgattctcctgtctcagcctcccaagtagctgggattacaggcgcatgccaccacacccggctaatttttttgtgttattagtagcgacgaggtctcgaactccagacctcaggtgatccattcacctctgcctcctaaagtgctgggactacagatgtgagcctggcccaatttcacattttctaggttctgtagaggttcatgtttgtggcatggtaattcttgttttttgcattttttttttcttaacccccctcctggcttttggagcactataaacttagcactggtggggccacatcttgacagcgagacccttacagcccccaaccccgcatcccagtggggcttcatgatctggccctgctgtgctggtggcatggccccctcggggcttaagtgattctgggtcattgacaagaatcttgcctgtgtgaattcaaatcaaaactttggagagcaaagattcagtgttttccttctgcctaacaatctcatggaaagcacagtggtacctagcatttagctcatgtgttcatttagcaggctctaagtcatcttgtcacatgtcatcctcatgtcagctctgtgtggtgttgtcgacccacgagcaaacgttgcaaggtcccctttagggtgacaaggctgattcaggatgtgtctcactgccccaggaaggatgcctctaacatgcggaacatggtgccagtggctgaggggattagttggggaagaagagtgaatagggaaaggaggttgttacatgatccacccctcactggccagagaggaaaaggaaggcatctcattaagagcattagctgtagcctctcatttaaacctcctcactaccccatgaagtaagcattattgcttttgttttacaggtggtgtgagacaaaagtgaaggaatgagactaattaataataagaatccatgccccaccatagctacgatgcagtggagcatggattctaaaccagctctaacatcacatgccctattttcgagcactagtggcttatttctgagctcttctcttcctctttcctgttgatgcttgagttttagttatatcatggcaaattgaaaaattcttcaaaaaacatacagaggaaataaagtggtgggatctgaaacaaaactcttattgattagccattctaatgaagatttgtggctgagatgggagttttgcaatcaccttgggatttcagaaccctgcttttaataattagaactaaagaagggagagtcctatagaagtgtgggtcataaaaccaaggatgtgaatgaggagtggcaagacaggtatcctggagactttatttcagtgagacttctggggcagagttgggactgatgggggacaagtcagctttggaatgatacagaatttttggctgtgacacctgtgtgattttagtgctttgcaccatatcaagagctgagcagagtgtggcaccaatattcaagggactcaaggggcaaatataggtgtcagtgagtgaaagcagatagcgagatttgcaatgcagtgtccaggagtgtccatctttctagacccatttctacttataagatcactgcataccctgtgaaacattatattcatgaagccacagagtttgagccactgtgtttacgctgcaagtggaaggagagtgggcatggagtcagaaagactcaagttcaaatccagcctccataatttatcgtctttaagaccctgggaaagttgacctaagcctctgttttctcagctttaaaacatgaataataatcctgcctcacaggactgctgcacatacggcagtcagcgcagtgccaggcacacacgagtgtcttattagttattattattatcaacaaagagcataggtgatccttcttatcatgattataaaaactgtggcttaccaatgaaagggtccttcataagccaacaaagagacatccctgaaattttcactatagcagaaatgcaaattattactgggtacatttctggcagacacatgagccatttacataatgaaacctctctaatattatttctattaatagcaatacttctgagtatcaatctgaccattttgtatttagaatcattctctctgtgaacagattccttttattgccatgtcgtcttaatatcttctgacaagtatcattatctctttgctgcatattctaatgtttatgattgcatgagttttaaagtgttcatttactacctgagaacctccattttaataatgcattgctttaatgttggtgtttgggaggtaaggttgttgcttattttctcagatgccgattcacagttgagcagatgatgacttgcaggaggctctcttgacctgtcatgctctgatatcatcaatgcattggagtggtcacttctgttagcttttcctccatgaatcccctgttgatcagcccactaagtgactcagcatatgtctgtgcacacctttggaccacattatcatccactcacttaggcccttgaatttttttatgggtatgtgggctatattgctaagtgataaggctggttctgtaaatggacctcgcaacttcagcataacaacggtatggctagtgtcctcctctaggagggactccccttgagggcagatacaggtttttcctgtttgcctcaagagagtcatacaatgcagaagtgcccaagtgaatgttgggtgaatcagtgagtgtaagagggcacccaagggaatgcccacagttggaaggaagttgcctgagaggaggagtcctcagacccattctagctttgtgattctgcccgtacagacatgatttatatgacaggaaaaacatggcaggcccttgggaagcattttcatcttaacctttataatatctaataaatgggcaagatgttaaaaaaaattgccctttccagaagaaggttatacagactctaagaaggcaacattaagaaatttttgaatttttttttttttgagatggagttttgcttttgttgcccaggctggagtgcagtggtgtgatctcggctcactgcaacctctgcctcctgggttcaagcgattctcctgcctcagcctcccaagtagctgggattacaggcgcacaccaccacgtccagctagttttttgtatttttagtagagacagggtttcatcatgttggccaggatggtctcgaactcctgacctcaggggatccacccacttcagcctcccaaagtgcagggattacaggcatgagccaccttgcctggccgaaatatatatatttttaaaaaggttattttcatcccagcactttgaaaggccaaggtgggcagatcacaaagtcaggagttagagaccagccttgcaaacatggtgaaaccccatctctactaaaaaatacaaaaacaattagctgggctggtggcgagtgcctgtaatcccagctacgcgggaggctgaggcaggagaattgcttgaacctgggaggcgaaggttgcagtgagccgagattgcaccactatgctccagcctgggtgacagagcatgactctgcctcagggggaggcggggagaaggttactttcaaccccatgaaaaagtgagcaaaggacatgaacagacacttttcaaaagaagacatatggccaataagaatatgaaaagcagctcaatatcgctggtcattagagcaacgcaaatcaaaagcacaatgagatactatctcataccagtcagaatggctgttgttaaaaagtcaaaaaataaccagttggatgctgatgaggttgcggagaaagggaacacttatacactgttggtgagtgtacaaattagttcagccattgtggaaggcagtgtggcaattctgcaaagagctaaaagcagaactaccattcgacccagcaatcccattactgggtatctacccagaggaatataaatcattctaccataaatttagacacatgcacgcaaatgttcattgcagcactattcacagtagcaaagacacagaatcaacctaaatgcccatcaatgacagattggacaaaaaaaatgtggtacatattaccatggaatactatgcagccataaaaaaggaatgagatcatgtcttttgcaggagtatggaaggagctggaggccattatccttagcaaactatcacaggaacaaaaaactaaatactgcatgttctcacttacaagtgggagctaaatgatgagaactcatggacacaaagaagggaacagcagacactgggtcctacttgagggtagagggtggaggaggaagaggagcagaaaaaacaattattgggtactaggcttagtatctgggtgacgaaaccatctgtacaacaaacccccatggcatgagtttatctatttaataaacctgcacatgtacccctgaacctaaaataaaagcttaagaaataggttattttaaagactatcctaatgcatttgtttgtgtgtgaaatatggttttgctaattagtattctttattgccagtaaaagtaactcactagagggagcttctaagaaacggggattttgatgagggcacgtggatatcccatggattttagggacgggcacggctgggccttggggaaacaaaacaaaacaaacaaataaaccaaaaatcaaaaccaaaaattcacattgaatttggagtttgggtcatattgtatgaacaggactgcttccacctgcattaataggcaaattccagaatactgggtgctgaatgaacagtccagtatggatctgtacggaggctgtaccaaggattggtgtctgtttatttttatttgtgctgctattgaagattttctaatcattagtgctaatattgcaggagaaaataattaatgaaggtgtctactgttctattgtagtaatttctgtttgcagggctcattaacatctttgatcagaatgagcagctcttttctggttggaatagatgaaaattatacaatgtatggagccattcttcaccttgtccttgtttcttcttcatgttgcttcgacttattgctcacaagttgacctcccccttagagctggggtggtccagcagggctgcgttgtgatgtgtattccttttgtgataggagacttgctgagagaggatcctgtttttttgtttgtttgtttgctttgagatggagtcttgctctgccacccaggctggagtgcagtggcatgatctcagctcactgcagcctctgcctcccaggttcaagcgattctcctgcctcagcctcccgagtagctagtatgacaggcgtgagccaccacacccggctaatgtttgtatttttagtagagatgggatttcaccatgttggccaggcaggtctcaaactcctgacctcgtgacccgcccacctcggcctcccaaagtgctgggattacaagtgtgagccaccgcgcctggccgaggaccctgtctttaatgggatgttgggtgatatgtatgaaatggttcaagaagcagatgggaagtgtttgggaggcctactgccagtggctcagtgtagccagggaaaaacagacacacctctgtgccatctctcacatcttagaaggtaacattgagtttgctgcatagaaccatacagttctaggtcacctgaaactcagagctcatgtgatctaaacttctatatttaaaggaggaaagagactcagagaagtaaaaatggcttgaccaagaagtcagactggaaccagaagtggacatatggactcctcattcctgttccagtaccgttgctgccagttcacattgtctttctaaaatagccatttatagggccacagctccatctcaaacaagggcttagtatctgtcagtttgcgaggtctaccataacaaagtaacccagactgagtggcttaaacagcacaaacttattttcttatgattctagagacagtaagtttgaaatgaaagtgtcaggaaagttggttccttctgaagtccttctccttggcttgcagatggccatcttccccctgtgtcctctcgtgggcttccctccaagtctgtgtcccagtctcctgttacaaggacaccagtcatagtggaatagggccctttcatatgaccttattttgttttaattacctctcaaaaggtccaatttccaaatacagttatattctgagaaactggaagttagggcttcaacacatgaattttgagtggttgtggggggaaaaaattcagccagtaacagtatccataagttaacttgattcattagttgattaagtatgattaaaccagctgggcgcagtggctcatgcctgtaatctcagtactttgggaggccgaggtgggtgggcacatcatctgaggtcaggagttcgtgaacagcctggccaacatggtgaaaccccgtctctactaaaaaaacaaaaattagctgggcatggtggtgcgtgcctgtaatcccagctgcttgggaggctgaggcaggagaatcacttgaacctgggaggcagagaggttgcagtgagctaagatcacatgcaccactgcactccagcctgggcaacagaggaagaccctgactcaaaaacaagaaataaagtaaataaataaatattattaaactagattatattggttaccaagtctttacatgaccattttaatagccttttcagatgttaactttgcaataatatgcagccagctaattgaaaattctagtgccataaatgtttttaattgcttactatgtgtcaggcgttgtactaggcactggggaaaactgtaaataaaagagacccagttccttcctttttttcaggttgcagtctatcaggaaaggcagacatttaaaaagggtcttgtgaggactgttatgaaacaggaagtacgagtgccatttctataccttagtacaatcactcgttttaattcacatcttccatggtggcaagtttgcctcagtgtcagccggtcaattgccactcaaggggatcagaacatttatgtatctggaatgcttggtacctagagttctgaagatcactattctcattccaaatatgttttttcattgccagaatgctcactcagtgactggattagttatgtgtactctgcatttttcgaagaggggaaagctgctatttttatcatctagtagcattctgatgactccttgataacatggttactatacggaaccccatctgtttctctgctgggaccacatcttagtcatatttttgtccctaatgtctggcatcgtgcctggcatttagtaggtcttcagtaaatatttgctgaataaatgtatgctgattgaaaaattgcctgctattatcagctctctgtgcatgataaatgccttgcctctccaaagcgattgtaagcttctgagcaggaacaccatggtcacacatggtctgtctaactcagcgccttgtaaataataggaatgccatccctaaatccctagccccctccaggatggcctgtcttccttgcatctgggactgttgaagattcttaatgatggaaaaatcatatacaggttattgcatagacatacattaaaaaatgtagttcgttcagtgtatccctagtgggcctatggccataaattaacttgctcccagggtaggtagtactctcttcttcacttctgctgtaatcacagctgccttcattatagaatcatagagaagtgaattaaggtgaactttgaaagaaggaagagatgcagctcacttgatcgatgtgggagtgggagtgggaagatttttctaggcataaggatggcatcaaagaggcttggctgtttttccattcccagtaatcgttgacagttttttatttaacatttaaaaaagtgtcctccgaaccttaggctgttcaaaaacaagtatttcatggtagagattacgtcaaatgataagcgatgcattctgcgatcagtggcagaaacaaaggttgaagctgcagtttgatgagaatttaaacatacagaagtcaaaaaattcaggagttgaagttaaactgcaagtgtgactcagtcccctcgggcatatggtagtagcattttctgaattgtggcatattcagttaaatttaagcccttgtttttgcagagtcgttgtgtcaaggttgcaatgtgagcagtaactttagactttcacaattttttatattctcacccacagtatgtgctgttatagcatttgtgcactgaaatttggtatagcttataaaaataaaaaaatggtgcaatgctcaatctatggtgcagaatgtatatgattatgaaggaataacccttctgtttgcttgaacccgacctaatactgaaacaaaacaccgccacttttgcttttaagtaaataaataaaccatacattgtggcaaaaggcatacactataaaattgaccgtcttcaccatcaagtgtacattcagtggtattaactgaattcacattgttgtacaactgtcaccaccatccatctccagaactcttttttttttttttttttcttgagacaaagtctcgctctcatcccccaggctggagtgtgatggtgtgatctcagttcactgcaacctctgcttcctgggttcaagtgatcctcctgccccagcctcccaagtagctgggattacaggaacctgccacgacgcctggctaatttctgtatttttagtagagacagggtttcaccatgttggccaggttggtctcaaactcctgacctcaggtgatctgcccacctcggcctcccaaagtgctgggattacaggtgcgagccaccacgcccaacccagaactctttttattttgcaaaattgaaattctacccattaaatagcaactcttcttttcccttctcccccaagcccttggcaactgcttttccatttctatgacaatgtctactctagatacctcatagagggtgaatcatacagtatttgtccttttatgactggcttatttcacttagctgctatattattaataccagctttctggggatataattcacaaactgcagaattgaatggtttttagtctattcacatcggatatgtttttgaagagacagtaaaaccaatccttttttccttagttctcagacacacacatgcttcttatctggcaagtcccgttataaaaatgccatgaactaaatgggaacagaagattgggggaaatatctagattattcttagtttggttcagattaattgagatagccagaatatttttgtaagcatgtttgctttaatttaaatgtcttcattttgcttcctggagccagcaatatgtgattacttattgttgttcttatggggtattgtttgcttgcgtagttgattgtgatgagttggctagaaatttaacagaatggaaatttcttcaagtctggatttgttcaaagaacagtttgaaattgaccaaagcgatagatggaactgacacttgacttatttgagatctggagttcccagtaatgaatattttggtccaagtttgaaaaatggcatttcatgtttatgtactgctgataggaatattcattggtacaaccatttagaaagacagttaggtattatccagttaacaaaaacaaatgtgtataccctgtgactcagcaattttccttctaggtgtttcctagagacttctgtactgtataccacgagacatggaggctctccagcacagctttatttgtgttaataatggtttaaaaaaataaacccaaactacttgaatgtttattaaagtgaaataaacaaattatgatatgatcaaatgacagaacacaatacaacaatgaaagtgaatgatctaaaactatataggagcaatatagatacatttcagtaacctgatatgaagccaaaaaagttacgttgcagaaaaattcaaaatatgaatgattatttttgtaaaatttcaaaagtatgcatcattaaacaagtaaagtggaatttcaccctgagacagttaaaaaaaaaaggctagaagcttagaaagacatggattagaactcgtttttctctgttctgagagtacatgtggaaatgaaagctaccagctatttctgccattttaaatgctcatatgaaatttctaagtaccctgcatagtaagtctttaaaatatcacatacacactactggcaggctaaaaaccaacagaaagatggctgggtaaaaagaaatcatgcatgcagaacactcttacttttaaaaatttacattcctgaaatagaatttttggagagaagcttttcttgaatgatgttagattgaaggatataactaaaaatagaactgcagtctttaataaatgaaaattagtcaagattctaattagtacttcctgtgttcgatactaattttgtcagttcatttctttacttaatgtgggctgtacctattcgcacatcccttgtactctttgcttgtttggttatcgttatgagaccaccaccaaccaccaccaccaccaccatggtcatcatcatcatcaccatctcctagagcacatggttttatgagccctgagctaagctccttaccgtttaatgcaaacatgttcctccctcagggtctttgcattactctaaaataacaccctcatcagtttttatccccttcaccggtttaatttttccttattgcacttacacatacttgtttgtctttctcatttcactaaaatttgagagtgatgttaagtctgtggaagcagagcccatgcttacatctgtcacttgtgtatttccagtgtttaaaactgggcctgtcacacctagaagctcactgatcataatcagtgatcatcaagtgaatgaatgcctgaattagcccaacaactctttgaggtagttattgctgttactattctacagatttttaaaaatggtggcactcagatagattaaactactcgcccacatttacccagcttgtgggtggtggaggctagaattcaaagccagtgtgcctgacaccaaagcctgttgtcttaactactccacttttctgcctatcatctgctgctagttctcagtgactttttatttatttatttttgcatagagcatcttttcttcttttcgggctatcaactcatcatttgtttaattctttgttttttgtttttgagatggaatctcgctctgtctcccaggctggagtgcagtggcacgatcttggctcactgcaacctccattgcctcccgggttcaagcctcagcctccctagtagctgggattacaggtgtgcaccaccacacccagctaatttttgtatttttagtagagacggcattctccatgttggccagggtggtcttgaactcctgacctcaggtgatccacctgccttggcctcccaaagtgttgggattacaggcatgagccgccgggcctggccttgtttaattctctgtatgcacctttttgataaatagttgtgtctccttttagggctatttctgttttgcatatacaaagactttactcatatttcaggttcagccaatttcagcctcttgcagctaacgcccttgccgtgtttagtgctattgtctgggctctgagactgaagcaggtctgtgagagcagccgacaaggtgtcaagaaggaaggatgcaataacccactgagctgcgttatctcctaaatgcatgtgtctttatgccattgctaatggcatctaatgaccttgggctccgaacaggtgctgccttgtaatctgcgctcatttgtctctttctacactgctagatttactgaaataacatgaacagggaaagcaaatgctttcatggatgccaggaatgctttatttatcttttaattttctttcatttgtttcgggatgtagaagcccactttggagttgaaataaaacaactaatgttcagagctgaggttgtcaccctttttagtaggacctcagatctagaaagggccccagagagttctcctttgcttatagaggagagtgtagtcctgtgggaccacatgtggtgctggccagcggagtaggtgggggtcctagaacttatgcagcctgactccctttctggggctccttctgaaacccagtggcatcctccttggcactttgcacacccagctgtaaatacacctgtgccatggagggctaaagccttttgggggggcatatatgggccaactgatgatcaacaacctctgttttcttagatcatctagcttctttatataacgtacctcttcgacttgggttgaccaaactcagatgatctccttaaagatgcatattaaagattgccccaatttcttaggatcctaggatatgagaatcttcatctctctctctctgtctgtgtgtgtatgtgtgtgtgagagagagagagacagagaaatttgtcctaaggaaacaaccagagatgttgaaaaaagatatatatgttcaagaagtccagcacagcatcactaaacgatagcacaatatctggagaattgaatgctagataaatagattatggttggaaattatagttatgttaaatattcacatattctgtgtgtgtgtgtgtgtgtgtgtgtgtgtgtgtgtgtgtttgagagacagagagagagagagagaatatgtatgtgaatatttaacattttgtgtttacagcctttgaagactactgcttttcctctagcatagaaataagatcaaggtttctcctactgtaaaagtttggttgaggggggttattgttttaaaatcaaaataatactaatatataatgagctcttattatggtccagatgctgtactaagtgctttacatacatgtaaaattcaattgccacagcagcccaacagcatagtgttattagccccatttgacagaacaggaagttgaggctcagagaggataagcaacttgcccaaggtggcagatcttaaagtgatagagctatgttttttttttttctttttttttttcccttagagacggagtctcattatgttgctcaggctggcctccaactcctgggctcaagcgatccttgcccctcagcctcctgtgtagctgggactatagtgcatgttgccacgcatggctatagagctatgatttgaatccaagcagtctgactccagggcatgccccagaaattgtttattgtttccctgatcacagaagggatgtatatattcatttagaaaaactggaaatacagaaaagaatgcagagcagatcacgcatacgataaatatgaacatttttagtgtctctagtcatatagattttttaactgggatcatgctgatttactgtttgtgagctagctgcctgatatttaccaggggtctgtatattgtaaacatgctgctgtgtgattttcaagcccacacagtgtgatcttagggcctatcgtaagttttacatcactcatagatactgtaatttccatccataatctatttatctagcatttaattttccagatattgtgctatcgtttagtgatgctgtgctggacttcttgaacatatatatcttttttcaacatctctggttgtttccttaggataaatttccagaactagagctggtggctcaaatagtaaggccctttataaggcttttgatatgtgttattaaattactcttcttgagcacttgccaaccatgacaaagaacgttcatgtgtctgcactctggacaacactaagtactgtaattaaaaaaaaaagaaacaaacaaaaactctgccaatttgataagttaaaaattatatcttgttttaatttgctttttttagtgtagtttcaagtgagggtggatattttccttatgtttctctgttttttacatttcttttttaaattggccattcgtgttcattgcttatttttgtcttagaaagtttttccttttactcacaattacatgtatttattttgtattaaggatattaactctttgtttaatggtattggaaatatttttcccactttgatattttcctttgaattttacttacgttgatttttatttacaaaatcaaaatatctgtgtagtcaagcatattaataattttcaaaaagtgttttgctttttttttttcccacagttgaatcctttttttttttttttttgagacggagtctcgctctgccacccaggctgcagtgcagtggcacgatcttggctcactgcaacctccgcctcccgggttcaagcgattctcctgcttcagcctccagactacaggtgtgtaccaccacgtccagctaatttcttgtatttttagtagagatggggtttcgccatgttggccaggctggtcacgaactcgtgacctcaggtgatccatctgcctcggcctcccaaagtgctgggattacaggcatgagccaccacaccctgcctgaattcttttgttttgtttgttttactttaagttctgggatacacgtgcagaacttgcaggtttgttacataggtatacatgtgccatagtggtttgctgtacctatcaacctgtcatctaggttttaagccctgcatgcattcggtatttgtcttaacactcttcctccccttgtccctccctccgacaggccccggtgtgtgatgttcccctctctgtgtccatgtgttctcaatgttaaactcccacttatgagtgagaacatgcggtgtttggttttctgttcctgggttagtttgctgagaatgatggtttccagcttcatccatgtccctgtaaaggacatgatctcattcttttttatggctgcaatttttttttaatttttttttttgcttttatacctagaaaagccttccattcactagggtcagataactatttacccacaatttattgtagttctttattatctcatagtttatatttatcgtttattttgatgtgcgatcttagacatgaggattcaatgaacttttgtcaaatattagatcagttgttctcacattatgtatttattagtcttttgccccactgagaggagacatcatctttattaagtactaataaaaactaaatgtttttagaaacatgagtatatttcttttttttttttttttgagacagagtttctctctattgcccaggcaggagtgcagcggcgtgatctcggctcactgcaagctccgcctcacgggttcaggccattctcctgcctcagcctcccgagtagctgggactgcaggcgcccgccaccacgcccggctaatttttgtgtgtgtttttagtagagacggggtttcactgtgttagccaggatggtctcgatctcctgacctcgtgatccgcatttctaagccttatattctgttatcttgatatttgttttttttctattttgcttttgattctatgagtttagaagattttaatataattagattctttcatatattttttttcagcatttattagctatttttagtctatttattctttcatgtgtacatagactaatttagtcagattttaaaacatcttttcaaaataaaatttaatttaatagattagatatcaattcagagagaatggaagtctttactgaactcttgtaatttttgatccatgcacaatgtttttcctttagttttttagtaatgcattttctgtttttatagaatctgagcagttcttgttttctttagagattttacagtgttggttataattgtgcacttaatctttattttccttatacagtagtccccccgatcaactgggggcatgttccatacccctggtggattcctgaaactgccagttagtaccaaaccctatatagattgtgttttttcctgtacgtacacaccatgataaaattcaatgtataaattagagattaacaacaataactaataatcaaataaaatacttatataaaaatatactataataaaagttatgtggatgtgatctctctcagtctccaaatatcttcttgtactgtactcgcctattttcagacagcaaattgaccaataaataaaaccatggaaagcaaaaccgtggctatggggagactactgtataagggaaattttcacctgattatcattgcgttttaggaaaactattagtatgtctatgtaagtgtgtgtggaggggtatatgtatatcttctagtaactgaccattatatataattattaatatataatatatataattttatattatacattatataatatattttatataaatatataaaatattttatatatagtatataatatattataaaatatattatatactatatataaaatatattatatatattttttgagacacagtctccttctgtcacccaggctggagtgcagtggcatgatctcagctccctgcagcctctgcctcccaggttcaagtgattcttctgtctcagcctcccaagtatctgggattacaggtgtgtaccaccacacctggctaatttttgtatttttagtagagacagggtttcaccatgttagccaggctggtctcaaacccctgacctcaggtgagccacccaccttggcctcccaaaatgctgggattacagatatgagccactgtgcctggtcaactgaccataatattgatctcagttctagagtctttcagctaattcccttagatattctaagtagacaataacatttccaataatgataattttgtctcctgtattttaatatttttaacttttatttcttctacagcatcctgatggtatgccaaataataatggaagagcagatacaaatacacttgactttattcctgaatttaatttttttttttcttgagacagagtcttgctctgtcacccaggctggagtgcagtggcgcacgatcttggctcattgcaacctctgcctcccaggctcaagtgattctccggccacagactcccaaatatctgggattacaggcatgcaacaccatgcctggctaatttttgtatttttagtagagacggagtttcaccatgttcaccaggctggtctcaaactcctgacctcaagtgatccacccgctcagcctcccaaagtgctggggttacaggcatgagccaccgcatgcagcctgaatttaatcattgactcttgtttttaacttttaatataatattggctactggtttgtggtaggtatcttttactgtggcaaatacatagtattctattctaattttcaaccctctttcccacagaatatttaagagaaaacctttttggccgctttgataatgataatttttgtctattgaatggtgatgctgtgattttcaggatgtatgtatcatggaaactggtagagaaagaaagaactgagatcatgctgaagtatactggggcccaccaagaggtagagctgagtgcaccaattgtcaccaaaatggcaacccgtaaaagagaaccattcttaagaaagagtcatgtaccatcaagcggggatttccagaagcctctgatagtaacagttctcccttccattcctttcctctctactttcaagatgcgatgatgacaaaaagactgacttgtcaaaaaaaccatgaaattccatacaaatgggcaagctgacatatagcagcttcggaaatttccacaatcgctcctctgagttgcctcaaggagaagaaaagtgagagaaaggaagggtacctttgcccccattaaggcacatgtagcatcctggaagctttgaaattacctgtccccaaagttattagaattatgtcattttttggttgttatattatgaaagcctccccacccctaaaagtttgtctataataatttttttgatcaggatttttacttcttaaattaatattaaagcattttaatgtttctagaaaatttgtcatttgtatttatattattttattttatttcattttattttatcaagacagggtcttgctctgttgcccaggctggagtgcagtggcacacgatcttggctcattgcaacctctgcctcccaggctcaagtgattctccggcctcagactcccaagtatctgggattacaggcatgcaacaccacgcctggctaatttttgtatttttagtagagacggagtttcaccatgttcgccaggctggtctcaaactcctgacctcaagtgatccacccgcttcagcctcccaaagtgctggggttacaggcatgagccaccgcatgtggcctgaatttaatcattgactcttgtttttaacttttaatataatattggctactggtttgtggtagatatcttttactgtggcaaatacatagtattctattctaattttcaaccctctttcccacagaatatttaagagaaaacctttttggccgctttgataatgataatttttgtctattgaatggtgatgctgtgattttcaggatgtatgtatcatggaaactggtagagaaagaaagaactgagatcatgctgaagtacactggggcccaccaagaggtagagctgagtgcaccaattgtcaccaaaatggcaacccataaaagagaaccattcttaagaaagagtcatgtaccatcaagcggggatttccagaagcctctgatagtaacagttctcccttccattcccttcctctctactctcaagatgcgatgatgacaaaaagactgacttgtcaaaaaaaccatgaaattccatacaaatgggcaagctgacatatagcagcttcggaaatttccacaatcgctcctctgagttgcctcaaggagaagaaaagtgagagaaaggaagggtacctttgcccccattaaggcacatgtagcatcctggaagctttgaaattacctgtccccaaagttattagaattatgtcattttttggttgttatattatgaaagcctccccacccctaaaagtttgtctataataatttttttgatcaggatttttacttcttaaattaatattaaagcattttaatgtttctagaaaatttgtcatttctatttatattattttattttatcaagacagggtcttgctctgttgcccaggctggagtgcagtggtgcagtcatagctcactgcaaccttgaacccctgggctcaagcaatcctcccgcctcagcctcccaagtagctgggactgcaggtgcatgccactatgcctggctctttttcttttttaacttttttgtagagatggggtctcactatattgctcaggctggtctcaaactcctgccttgagcaatcctgcctcagcctcccaaagcatggggattacaggtgtgagccaccggacctgaccatttctatattcaaaattttgttaacacagtcaaatattacatattttaaaaatttaaaacattctcaatatttgtgaatttattccacttcttatttttaatttggtttgttctctgaaacttaagattagctagcagtaagtcaatcttatttttgtatatattttaaaacattttgtatatattttaaaatatatgcaaaaataagatagacttactgctagctaattaatagccttttaaaataattttttttttttttttttttttttgagacggagtctcgctctgtcgcccaggccggactgcggactgcagtggcacaatctcggctcactgcaagctccgcttcccgggttcacgccattctcctgcctcagcctcccgagtggctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaaaataatttttatctcacatttggatagttttatgtgcttttcctttatattgcttttcttaggtttatttccctttctttttttttttttttaagacagagtctctctctgtcaccaggctggagtgcagtggtgcactctcggctcactgcaacctccaccttacgggttcaagtgattctcctgcctcagcctcccaagtagctgggactacaggtgcgtgccaccatgcccagctaatttttgtatttttagtacagatggagttttgccatgttggccaggatggtctcaatctcttgacctcgtgatctgcctgcccgacctcccaaagtgctgggattacaaaggtgtgagccaccgtgtcccacccccttttctaatttattgagttgatcttttatttttaatttttcttaatgataaaaatactaaagatatttgcctctgactgtaagctgcctacactttgatacataattttctcattatctttattgtctcagtctgtgattccataatttattatcttttatactctacacctatttagaagaattctttttgaatgtacaagttaatttgaattgtttacacttctgtctattaatgagttttgttgcattgtggtcacagaatattgaaaggtagtaaaatttattttatgttccaatacaggattcatttttgttaatgttccatgagcccctgtatagaagatgcatgctctaattaaatctaatcaggcttatcttgtcatcagatctgccatatttatgattttatcctacttctctatatctttattaaattttcatctgctggccgggcgcggtggctcacacctgtaatcccagcactttgggaggctgaggcaggcgcatcatgaggtcaggagatcgagaccgtcctgactaacatggtgaaaccccgtctctactaaaaatacaaaaaattagccgggtgtggtggcgggcacctgtagtcccagctactcgaaaggctgaggcaggagaatggcatgaacccaggaggcggagcttgcagtgagccgagatggagccactgcactccagaatgggcaacagagtgagactctgtctcaaaaaaaaaaaaaaaaaaaaaaaaaaaatttcatctgcttatttttccaaggactgaatgcagtggggtagactttaacattattgcatgtctctcaatctctgttttattttctttatatatttccatgctctactatcttgacacatacaattttgacttaattctttggaatgtatctcttgtcagtaaaaatttcacccctgttgaatgctttagatatgtaatactgattttgtattaacagttgtaaaactgtcacttctaaatgtgcagtttcctggtattcctttgccccaatcttcttgtaacttttatgggtttcttgcagatagtctaagggcattcttaatttatgacaccatctgagattcttttgcttttcaaaacgaattaatacctgtcttcaatgttgatacgcttattctaatttttgtcatctttttattcttttggttttatgattccttgatatttccctcattttccattttgtgtgatatgatttactgtctgtaatactcataccttatatttaatcttctagttgtcttcttaaatttgactaaatatgacctatatttctgtatgagcaaagtgaggaagctggctgaccatacctcctccctgtataagataagattaacacattttattctcctttggaattctccttttcttttttaaagttagatatagacatatagatgttttgatccagtttatgattacttttaaatattatgtaacttttcttaataaggattatctatatctgtgttcctttttataacgatattcagttgtttgttatatgctctccttatatgtgtatatatttttctctagagacagggtcttgctctgtggtgcagcctggagtgcactggtgggatcataactcgctgcagccttgacctcctggctctaaaggatcccccacctcagcctcctaagtagctgggactacaggcacacagccccacgcctggctaactttattttttttttttttttttatagatgacgtctcgatgtgttgtcccgggtggttttaaactcttggcctcaagcaatcctcccacctcggcctcccaaagttctgggattacagggatgagcccctgtgctgggcctgaatccatattgtgaactgttttaaagcacaactaccccttttctttattgtttaaaattaaatttttgattgattagggagcttcttcaaatatattctatgaaatacattgtgtttttgttgctccttgggatccaagaatgccttttttattttttaactctcataccttagtaggaaagttggttagtttggaatttttgtatcagaaccctttgccattagagctgtgtagttgttttatttcttctattgtcagaaatctgattttttttccaccttggtgacctggttacctgtatttcttttcctcctcactgaatgcttatgagttgttttgacctcaaaagttgcaccagaaggtaaataaatagatggaagttttctttaatttattaatttatattaatatttatatcagttttcatttttttcttcttgtatagagtgagtttttggttggttggttggttggttggttggtttactctgtatttcttcagtttagaaaaattttctttcattatttctttaataattgcttctgtggtatttactttgactatgcatcaatcatgctatctctatgttggcttcctactttgtctcctgtatccattagcatctatctgatttgtttatacttttcatcttttttccagtgccttttgggagactttttcaggtttgttcttcacttgctggtttgatgctccaaaggctgtttttccttttcattgcatcgaatgtagttttaaataatactttggaaaatcagtcattgaaaaaaaatcctaatttttttttgtaagttggtgtttctttttgttttcatttacttgtcattcacgcctaagtctgggtctcctccccttctttttcctcctccttcttcaaaggtgcaaatcacatcttgtctgaaacttgtttctatttccagtagtaaatattttttgaaatcgtcttcttcctttatttcttggatgtttcttgttttgttaaccaagtccttataagcccaatgttgccagttttgggtctgctcatcattgaatgatgggagggctagcccgccctggaaattgttctcaaataatctctgtaccattagggaaaggttggactcctttcctcggtcttaagctgaaggctttgttcttaaaaatgtactagaccaggtgtgtttttcagcagctgcacaaatttgtagggagctggagccacagggcaatctctattggggttcttccttgcatggttgctgcttggcaatgggtgaagccatcgtgcaagagacagtggttctcattctgaacttctccctgaccctagcttcactccaagccccctttgtagcagaggatgcatttttctggcatcagagtcctgctatgtagagagacatctcacatcccaccagatggccatgggcatggaggacttatgcttggttctcttcttagtgccttccgaatgtgaatgccctggacaccagacactatctggtttgctagcctgctctcacctccagcgttcagtccattttaggaagatttctaaccagtgctctgtcagaatctcttcttgtttcttctcacagtgctgtgccaccttttcaagaaagagaatcccaacacacatttctgattcagccttttatgtgatgctttctctggtctatctaacaaaatgtcttaatgttaaaaatgctgggtgccctccttttttttcagcactggtgtagacttccccccatctttatatttgtgggaaatggatgttcagattgatgacgtgctctaaagacagagaggggaaatttacaaaacacaaatggagaggaatgtgaattttacaaaagtatttatggagttctctaaataatgaactccctcaggacacttagcacaccaagtaatgtaaaaagttaggcttacacgtagattgtcagacacacagcttttgtatattgtaagctacacctgtatccctgtaatggtccccaggagtatcacgctgcatggtccaattaggtacagaagaactctcaagtagcagccagtcactttgcctgtaataatgtttatgattcagagtggtgcccaattcaccctttgcacttttcccagtggcatttggcagctggggcctggttattcagcagattattgcttctccccagaagcttttgtgatccttgcaggcgctctcctactagggagagaagaatgccaacatattttaaggaaacaaagaataatagtgtcacacgtctttgaataagagtgaaaaaatagttctccccacatccaaacacagtgtagtcaaaattaagaagatagaaatcaagtgtgcatgggcagagggtaggtcataggcttaatgaacccagaagagctttatttattgacttctattttatcccttctcactggtccagctgcaatgattgtcaacaaaggtgacttagaaaaagagagaccttggagagagacagaaagagagagagctggataggcagacagatgtagagcaggtttgtttgcttggcagaacatccaagtcgcagatggttctagaacagaggtaatattgccagggttgcgtggaacagatctggactaaagctgaggcttgcaggtaaagccagtggctcccactccaatgtcattcagcacatagcaatttcagctggagatctgtttatagcataaaacagacactgcagacttttttctccatgagactttaatgtttcatttactaacaagattatatatgggaagtggatgtcataagaagactgtagaatcctattgtctcaccaccgattgaggggcctttgtctatagaccaagcacgtctttttcctcggatgccttgggcatttcagaccatgcccaaaaagatatgttgtgacctgcagacctgtggttgaccatattaggatctgtgatcaatttcttagagattttgggcataaaaaatgagcaaagagccatctttaggaatttggggatatgcttgacccaaggtatttttgttttctactaacacattttgatgtaaagcaagaagtggttttcaacagttgaccatggttgcctagagagatgggtacatattcatgtattttgacctatcagatggaaacaggcttcactcttagaacttccctttggatttcccacccaccccagacactgacattccattttgaagttacacatgaatataacactgacacattgggacatgctttccaagctcaattaccatgcagcgcaatatcaattaagtggatcatgaaacatgtgtctgattgtctcacttgcataatttacattttttgacaacacttaattctcccttatatgtccaggtttcctattttgtgatgcacataattgcagaacttgggagctagaatggaccttggagaggtcccttacgccaaccctttcacttcacagatgtagaaactgaggcttagagagggtataactttcccaaggccacaaaggactagtttacagcagagctgggcttatataacagggctgcctggccggacgcggtggctcatgcctgtaatcccaacactttgggaggccaaggcgggtggatcacctgaggtcaggagttttaaactggtgaaaccccatctctactaaaaatacaaaacattagctgggcatgttggcgcatgcctgtaatcccagctacttgggaggctgaggcaggagaatcgcttgaacccgggaggcagaggttgcagtgagccaagatcgcaccattgtactccagcctgcgcaataagagcaaaagtccgtctcaaaaacaaacaaacaacacacacacacacacacacaactcatggaactgtatactttcccccaaaattcaatttagggccgggcgtgatggctcatgcttgtaatcccagcacttcgggaggctgaggcgggcggatcacgaggtcaggagatcaagaccgtcctggctaacacggcgaaaccccatctctactaaaaatacaaaaaattagccaggtttggtggcaggcgcctgtagtcccagctacttgggaggctgaggcaggagaatcacttgaacccaggagtcggaggtcacagtgagccgagatcgcaccaccggactccagcctgggcgacagagcaagactgtgtctcaaaaaataaaaataaaaaaaaaaacccacaaacaaaaaaaccacaaacaaacgaacaaacaaacaaaacagggctgcccattatcccctgcatggctccagagctattcttaagatcctctgcactttggatcttaagataacattagatttcatagtatccatgaaataacttagacctggtcttggaaatacgtttcaccatccaggtacccatcacatgtgttcgcaggtgaggctttcttagcagcactatgtaaggagacatagtaaagaaatatttattgaatactgaatattgattgagcctatgtcctgtgctaggtgttctaaatatagaaccttatctcatcccataactctttgagttaattgtcattctttttgtttgtttgtttttgagacagggtctcgctctgtctccagagtgacacactgtactccaggctggagtgcagtggcgtgattgtacctcacagcagccttgaactcctgggttcaagcgatccccccacctcatcctcctgagtatctggactatatgtacgtgccaccacacctggctaattttttaaacattatttgtaaagttagggtctcacatgtttcccaggctggtcttgaactcctgggctcaagtgatcctcccatctcagcctcccaaagtgctgggattataggcatgagacactacacctggtcagtatcgttatcttggccattttacggttaagggaatatagacccggcaagtttctatagcttgttccagaccacatagctagtaagctttgaggctcatcctagggtcactgcttgaataacctgcatttttctactgtaccatatgtattctcctgctaatcttcttactgagagagatggtagttcttctaagtatcatatgatccaaaagttgcttaaccaagagctccagcatctgaatccctgagcatacctcttcccccatgcatcatacctgtttcccattctctttgaataattttgaattgtgagcaaatgttcttacaaaataaagaagagagtgtgtccctgcagcattgtctaagtgcagaggatcttaagaatagctctggagccttgcagggctcatgggcagccctgttatataagcccagctctgctgtaaactagtcctcttgtggccttgggaaagtcataccctctttaagcctcggtgtctacatctgtgaagtgaaagcgttggcgtaagggatctcctcaaggtccattctagctcccaagttctgcaattacacgcatcacaaaatagggagcctgaacatataaaggagaatttagtgttgtcataaaatgtaacttatacaagtgagtcaatcggatacgtagttcatgatccactaaattgatactgtgctgcatagtaattgggcattagtggaagcagttcacgtaaaagactataatttgtattacttttacaccattgcaacactttttattgttcctcagtccttgatttgttttctaatgtctctagtgtgtttaacactttctcttgttatgatatgcaccatacatgtgcatgtaatataattcacatatataacatgaaaacatctgattcccacatctaacagtcagacttccgttttcctcttttccaaaatccaggtggtcagctgggtgcagtggcttgagtgtgtatttccagcactttgtgaagccaaagtgggaggattgcttagggcaggagtttgagactagcctgggcaacatagtgaggcctcatctctacattttttttttttaatcagccaggcatggtgatgtgtgcctgtggtcccggctactcagaaggctgaagtgggaggatcacctggttccaggaggctgaggctgcagtgagctctgattgtaccactgcactctagcctgggcaacaaagcaagcctgtctaaaaaaaaaaaaaaaaaagaagagaaacaaaatccagttgtctgaagaggaacaacttcttcctgagacattttctttatttcttttaattttgttttcttttttttagatacagggtctctctccatcacccaggctggagagcagtgatacaattgtggttcattgcagcctcgaactcctgggctcaagcaatggtcctaccacctcagtcagttgagtagctggaactatagatgtgcaccacgtgccacgataatttttgtttttttttttttttttgagacagagttttgctgtgttgcccaggctggtcttgaattcctgggctcaagtggtcttccctccttggccttccaaagtgctgaggttacaggtgtgtgccatgtgcctggcctgttcctctttatctctttgtattgagaggttcttgagaagcatttccatctgctttccatcgttttctcccatgtgcagacttggttaaaagaccttgaggaatcccccctttacgaagccttatccatgagaggacaagataaggagacccttggtttgtggattcagcttccatggtcattcccatcagttcccaccacttctaggagagatagtatcactcgatgctgacctggaaaatcctggtagagacccaggaactcataggactcggtccccacaccctcatgccagtacctgtgtgacggagaggcgcccctttgcatggggtgctgcacaatgccttcgtcaatcttctgccactgtcctcatccccaccccagcctgctcacctcttcccctgtaccccacagccaccaggccagtttcacctggtggaacacttcccccacttcacctgctgtgcctcacctacttcctcctgcctgttctggtgaagcctcccgcgtcttttcttgtggtaatgctcttttctgcctctctaaacttctgccagtgtttttgtatttgatttttgaaattcaactcagacctccaaatgaggcctaagtcaagcctagcttttggcgagctcaccccatttatggtgggggcctgcctggtcacctgctcgtcttaaaacctgcctttccttatggaactgtgttttcaatgaggttctggccgctaagcactcaaggctgtgtacactcaactgttgggctgttggaggtctccccatgagaactttattacagaatggagtatggagcctggaaagggaaggtggcccagtgaggaatggtactgcattctcagtctctgggtgagttgaggcaggggaccagaaggagaggagggaggagtgggaaaggcttaaagcctcttggaaggagaaaagccaggggaaaggagaatggtaactgggaaatgggctaacctcagacctgcctttagcggacgcctggctcgagggcccaagacctcaagctctcagaaactggtaagaatcatgctgtcccaggtcccagtgaggtgactctaggtaggaggcccttagcagaggtggctgggtcaatcccagtcggctgcttttatcttttattttatcggcacttagaaagaaagtatggtgctccttctgagagggctctttaacattgcaatgggccaatcactttatatcattatctcataattattatattacattacattatattatgataattcctgttttgtaaatgagtagccgaagctcagttacatagcctgtccatggtcacagtggaacatgaacccagtttgtgatgtcaaagcatttctatctttatggcaagccttcataggaagcaaaagaagcttgcaaaagtaggagacgttaccttatcctctttccccgttcagaatttgggctgcggccaggctcagtggctcacgcctgtaatctcagcactttgggaggccgaagcgggtggttcatgaggtcaagagatcaagaccattctggccaacacggtgaaaccccatctgtactaaaaatacaaaaattagcagggcatggtggcctgcgcctgtagtcccagctacttgggaggctgaggcaagagacttgcttgaacccaggaggcgaaggttgcagtgagccaagatcatgccactgcactccagcctgggtcacagagcgagactccatctaaaaaaaaaaaaaaagaattttggctgctcactgatgttagaatttaaaagaaagtaaagtgatgcttcaattaaaaaaattaaaagcttaaaaaaattaaaagctttaaagtatggattttttttggtgggcggagcaaaaacagtgactgaagtgtattcatattgaaacactgtggtgtttcactggtgttcaagttgacagggcaggggtgggaaagaattacggagtagaaacccctggggcccaatggggaggcacctagagggcctaaggggaaggatcctacagatgaacttgaccttctttatgattttgcggaagacaactctgcttatctttcctctgggaccagtaaaatagctgttgggggcagatgctttgctgatgcttagtatacaaaagacagcttatatgggggcaatattaattttcttaagtcccttggcatggattctgaaaactttaagatttatgatttgagaaccctgactctaaaatacgtgagaattttctgcttgcaaaatagattacgcttgcacaaaatacgcttgcacaaaatcttctacttgtatttctactctggattgttgaaacaaattgattttttcttttttgagacaaagtctcactctgtcatccaggctggaatgcagtggtgcaatcttggctcactgcaagctccgcctcctgggttcacgccattttcctgcctcagcctcccgagtagctgggactacaggtgcccgccaccacacccaactaatattttttgtattttttagtagagatggggtttcaccgtgttagccaggatggtctcgatctcctgacctcatggtccgcccgcctcggcctcactaagtgctgggattacaggcgtgagccactgcgcacagctgaaataaatagattttaagtggctggctggctctcagattgcatcctgttagaaagtcagaatagaaaatagatgcattttagcagtgttggaagaataaactcaaagtcccctggaaatcctggaccccacccacctcttaccaagtatccagcaggaaccttcttccttactattgttataatacattctagccccagtaatttgttccacgtatctcattagagtgaagatagcaacatacttaaataagaatttcatttttcagttttagcttttgatgtaggctaaatgctctgtgtcacataacttagactacctacatgcctcatacactgataccctattttgaaattacacatgaatttaacactgccacgttgggacgtgctttctaaagttacctatgaaataacttagatccggtcttggaaacaccttttaccagctaggtacccatcacatagcttagtaggtgatggtggggtccttcgtttttttgactacccgtataatttcaggagcaagcctaattgttatgcctcctttgttattacctcccctagcctagataacatgccttccaaattgtattgagagtacacaggaagacaactgcagcaggcaaccagctctaacaactgcgtcattttctaagaatcaaaggaattacttgagtttctagttctggctttggcttgccagacatataccttaccccagcgaggtaaatgattcaatcatttgggaatgattgaagttgctgcctaattcataacttataggtgattaaacttgtaaagtattttgaggctgtttctttcattcatttattccaaacaaacatttgttgttgaatgggtagtgactttgattttaaaacactatacagacataaaatagtggcagcttgtagatagcaattttttaatttgctgtccttaaggaatttcgttaccaaatcctcacgaatcttgaaccttagaagaataatcctttcctttgttggagttttaaatttagaataatcagacaatagtgaagcattctgttcaaagcattccttttaggctacccatttattatacgctgctcttaagaggagatgaatttgattagcattgaacattcagtcagtgtttttgcatagctaatatcacggagaaattttcaaaaaaagttatgcctgctatttaacattattatacagtcaacttttaattatctgtattaatggaatgtaatcagtgatgtgttgctccaaaatcatttcctttggctttgagaagcaccggatgatgcttttattggtttgtggttttgcttagatagtattaaaattgtgccacatgtgtgcacatagctcatcttagggaggaagtagcccaaaagtatactgggggctagggaaaggtcaactggaatttttaaacctaccacagatacatatacaatggatgaccccaagattattcatcttaattattaaataaaaaacaatggccaagaattatataatggcagctgtgtaagaaaaaagacgcaatgaaccacatgtgagatttccatgtaggacacacattgtttcccacctttcccttttgaaatttcctgaaagtgaaacactctcataacactacagcagtgaacactgttagatttagtgatcctccaaatgcattttgctggtgctccaaataggcctcttgggggaacagaaggaacagaagggctgatgtcttgacatgttaatgtttctagataatgtcacctttaggtgtgatagctgttactgtttattattttttaaataaccctcttgttcccattcattcaagttaagctttttttttttttttgagacggagtttcactctgtcaccaggctggagtgcagtggcgcgatctctgctcactgcaacctctgactccctggttcaagctgttctcctgtctcaccctcctgagtagctgggattacaggcacgtgccaccatacccagctaatttttgtatttttagtagagacaaggtttcagcatgttggccaggatggtttcgatcttctgacctcatgatccgctcgcctcagcctcccaaaatgctgggattacaggtgtgagccaccatgcccggcctaagcttgttttttttttaatgaataacaatgatagaaggaaatctttggagggtttatcttcttagtagcggcctttcaaatttcaaaagtcttctcagtgcacaaatctgtttttgcatgaggctgctatagggccagcacttttagtcctctgtggcctgttcacctgagtgagtggtgacatttcttggttcataccttggaaggcaatgatggctggccctttagagtgaggtgaaggaagactgatccctgggtgtggaggtactgatgcataggaaaagaaaacatctttggtgacaccattgggtgtcagatcagtttttggcaagttggcaggaaagtctccaaatcagtggggtctggctgggcaccagcaagttggaagctgcattagttccttctgctggcatgtccccctgtcatctggccatagcctcatctgctcctactaccttgcaggtgcccttggggtaaagctgtccagatgcacatgaacccctcctcttttcagctggacaccaagccaggaaaaggagaggtgtgactttttgacggaggccagtttctatgtcagcagccttgccagtgaacactgcaaaatggtgtcagcctgcagcctttttgtgcactggagcagagctcccctcaccacatttgtgaaacaggttctgtcatggggcccaggtgtccttttctcctgccacccccactccagcttgctggccgccttatcattccacaccaggaagccagcatccttgagttgtccttacttcttatgacctgctgtgtagaaagagaggggaaaaccagtgtccgagtggctgctgtgggtgtggtctgggccgcgtagttttatatacgtaacaaccttctgagacaagcgttagtgactccttttacagcggatgaacttgagggtcaagccagtaaataatttcctcaaagtgacagagctggaaagtggtaaagttaggatcaatactcggctttgattttaaaatatgcatatgcatatattttggagatctggatataccacttccaaagtagcatattatactgaaatttcaaaagagaaaacatctttaaacaaaaggaaataactcttaattatggagtttcaggtatcaatgtgttgctggagggctgtgatcttaaaagcatgtcacattggcaacccgttccggcaggttgtgacaagctatgtagcatgcatgaaagcatcattcattttttaaaaaatgtcttcaccatttatttctttaattttttgttttaactttttatatttataggcaataattatgtatatttatggggtacagtgtgatgtttttataatgcatacattataacaagattcaatcaagctagttaatatattcatcacctcaccagtttatcattttgtgtgtgtgtaagaacattaaaaatctgtgttagcaatttacttcattcttaatggcagactcagcttctttttttttttaaatcctagactgttggcttctccttccagcagtgttgtaggactcagctgcctttctttgctgtccctggccagagatgtgtgcactcctggtctcctaataaaactttagcctatgctgggagccatggatttggcagcactgcctttagcatttaggaatatgtttctccttacatcaagaatagttttaggccaggcatggtggctcacgcctgcaaatcccagcaccttgggaggccgaggcgggtggatcacctgaggtcgggagtttgagatcagcctaaccaacatggtgaaaccccgtctcgactgaaaatacaaaaaaatagccaagtgtggtggcatgtgcctggaagcccagctactggggaggcagaggcaggagaatcgctagaatctgagaggtagaggctgcagtgagccaagattgcgccactgcactccagcctgggtgacagagcaagactctgtctcaaaaaaaaaaaaaaaatagatttatgctgcttgttgaggaccagcagtattctcaaccatgtgaggcattcttcgaacatgtgaagcagcattttcctggatgggcatttctgccataattgtgggcagaaaaaggtgtggtccacatatgcccaacagggccaaggggcaagggtgagcatgtacctatgtcttataccccggagattcttgcggctgacgaggttcccttacaaagcccaaaggaattctcctccttccaccggaggtgtttataacctctaatttgctcaccatgcttctagtggaaggagtaggagctcaatcccctgggaggctgcggcagagccagagcaggctggtgacccagagcagtggcactcccctctgagtgcatgatgcagatggagcaggagggggatgcaggtgggacaccctgcgccctgcaggtgagtgcacagccagcgagacacccaatcagggagcaggaaggctgtccctgtggcagcaggtaaaagagagagtcgctgagatgaaattcgtgggtgtgtgcttcagcttgtttgaacagctcctgtgcaagatcttatagtaaatgctgagcttctttgtgctctgtgcctgtcggtggaaggcatagcccttgatgaagatttctccttctacccatcttgcctttggaaagggctcccctttgacaaatgctgctgtagtatttgatgcagcctccatgaggtgctttgggtgggaagtggattctgacctcatttcccagaggaatttgaagtggaggggaaggactaattggtccctcattaaggacttacaatgaagtacagtatttctcctgaaaggataatctaagtcactggataaaatgcccaacacacttttaacgtgacataggaatccaaagtcatttttaaatcaaagatttttgtagttgtggagaatggctgtgttttaatgggatctttacatatcagcattacaaagggctccttcaaatgtgatgattttaatgtttttgctggggtttcacctgaggttccaaatacatatttccctatcatatttgcaggcatccagcacccgattttagatatgcaaatcagctcactttgtttaccaggctttggataggggagaaaaggaggtctgaggctgggcacggtggccacacctgttatccagcactttgggaggccaagatgagaggattgcttgaggccaggagttcaagatcagctttggcaagatagagacctcgtctttacaaaaaataagtaaaaattagccaagcatggaggcgtgcatctgtagtcccagctcctctggaggctgaggcaggaggattgcttgagcccaggagttagaggctgcagtgagctatgatcgtgccattgcacagcctgggtgacagagctagattcagtctctgaaaaataaaaaaacaaaataacggggctgcaaaagcttccttgacgaagaaggaaagtctctcgctcctgtttaacactgcctggctgggttccagctcactagcttaaaacgagaaggcaccaccactgtgattaaaataaggccctacttaattaaaacagtgtgagaatttaataagaggcataagacttcactgatagtcaccaaaaaatctcaaaaaggtgacttaacaggcattaatagcatatgttgcttgtttactctctgtcaacattccgttttccagagacatccttcgtacaggtgaaagtctctcattcctccctctcccctcactgcctgcctttcagccatttccttgctttttgtagttaaccagtaagaaagagaccataatggagaaagaacacactgactgtgtttcacagactgttgccctcatctccacttgtgttaaagaaggtaaattagttcccctccagattaacttcagcgtcagctgtggtgctttcctgacacttcttaacatttgaacagtaccacattctgtccgttttatcgttgtctcttctcataccctgtatttgccaattctgtactcatgcccagacagatctataggtatatgtaggaggatgatgaagaacgggccgattcgtagctcaccctttgagccaggaccaaaggtttgggagtcttaggctctgaccttattcttttggagaggaaagaatcattttcctttaagcctaagtctggcaaaatctaattacaaagtttttcgattttgctattttaaaataaaagctaagccttccccccatctaatcagccctctcttcctctgcttctaatagtgaaggaaataaagaagtctctcaatttcacaagcttgaggtacttatatttgtacatgatttcctgttctaagtgggtggttttggcccctggcacttcatgtacgctagggcatttttggacacttttggtatccaccttgcttaagaattgaatgactaggaaagaaggtcatggggagtcttcaaattattaaccctcagtccaatctaagtcattagttaatgccatgtttgaaggtggtaaagtaaccgtcatcttacgaagtaactctcgtttgttatgcttagtgctgaacaaagtataaactcaccaatgtgagagacagggacaggatgcttatttctttatggatatttagaatttgagcctgtaggctgggcacggtggctcacgcctgtaatcccagcactttgggaggccgaggcaggcggatcacgaggtcaagagatccagaccgtcctggccaacatagtgaaacctcgtctcttctaaaaatacaaaaattaggtgggggtggtggtgcgcacctgtagtcccagatactcgggaggctgaggcaggagaatcacttgaacccaggaggtggaggctgtagtgagccgagatcgtgccactgcactccagcctggcgacagaatgagactccgtctcaaaaaataaataaataaaaaaaaaaaaaggaaaaaaaggaatttgagcctgtaacaccaacttcagcacaaatagatctctttcttgattctgaaatgatttatcagttttaaaaaatggtggggtgcactgctggtgggagtgtaggttgatatagtcatttgggaaagcaatttggcactattgtttaacagtgaatattcatagacccattcctaggcaataacccagggaaacttatgctgatgggtattgttcctaatggacacagcattgtttctaatagaaaaaaaaacgaagctgaaaaaattttaaaggtcgtcaacagacatatatatatatattagtctaatatatgacaattagactaatatatatattaattagactaatatatattagcttctatccctgtagactaatatatattagtctaatatataataattgaactaatatgtataatttgactaatatgtatattagcttctatctctatagacatatattagtctaatatataataattagactaatatgtataataattggactaatatatgtattagcttctatctctccagactaatatatatatatattagtctattgagaacctttatatatatatatatatatatatgcacacacacatatacacgtacatacatacatatatataattttttgcttcacagaatggaatattatacagcagtgaatatgaaggaactatagtagctacctgtaacaacatggctaaatcttagaaacaatattgtgtgaaaaaaactagtcacaaaagactatatacagtatgatagtattataaagtttaaaatcaagcacaattaaactatgtattttagagagtgatagatagaaaatttaagatagtggttacccctggagagaaggcaggaggatggcttagggaaatagcaaataggtagatggatcaaaatacccctaaatgtctagttctcaaatagggtggtcggtgtatgcctgttcattttattcttatgcttcacaggttacgtacatgttagtgcattcttttgtgggttacaaacattgcatgatagaaatatttttaaagtgatagcatgtcagaattatggcttgttttttccatctctatttcctaacattctctttccatagtccccagggagggggcttgagatcacacaggagtaattagaaggtctgcttctgacagtgtcgctccttgagtggtggaggttttagggggaggctgacagtaactactgagtggaattgagaggtgaagccagctggacttcctgggtcgagtggggacttggagaacttttctgtcttccaagggtattataaaatgcagcagtcagtgctctgtagctagcaagaggtttgtaaaatgcaccaatcagtgctctgtaaaaatgcaccagtcagtgctctgtagctagcaagagatttgtaaaatgcaccaatcagtactttgtaaaatggaccaatcagcagggttctaaaagtaaccaatcatggggaggattgagaaaagggcgttctgataggacagaaacaggacatggacgggaaaaataatggaataaaagctgccccccccaaccccccacccccacccgcaccagccaccagtgcaacctgctcagattcttttccagctgtggaagctttgttctttcactctttatgataaatcttgctgctgttcagtcttttgggtctgtgccatctttaagagctgtaacagtcaccgcaaaggttagcggctccattcttgaagtcagcgagaccacgaacccaccagaaggaaccaactccagacacagaatcagctaggagacgtgggtgctttctgtatagtgcttcctaccaaaagcctagaaaatcttggggcgtggagaaaagaaaatccatcaagtaaaggcttgatcacctcttggaaaacccatattcattgtcccaacagtgactaatacgtctaactgtgggcctgggtaggatattatgagaaacctgttcttttggtgcccacctttcttttctgagcaacacgtggtcttctgagtgaggcaggagtccggcatatgcgtgatgatgtaatatgttaggcagccaggccctcaccttttcaaaggttcgatcttgaaaaatcaaaggtggatatgtgagaaataagcccatataggaataagaatgacaatggaagtggaaaatgtaagttgggactgatgttctgctgctttgagtactgaaattctctgctgctcggattcatcatcactgaagtgctggccagtactgggaggggggcagagctctcccgggagtcgtcgcttattctgaaacagctgagcagaataatgagtgacaggctggtggtggggaggttgagtcttactccggatttccattaaatgagtgcatggaatcaatagctaactgaacatttgtctttagaacacccaggggcccctggggaatttggtattttcagtctaattctcagacaggaaaatgcgcagcatgactattttttaaaatagtttcaacatcttttatgtaatgctgatgcatctggaagtgaaaacgctaagagtttcatttcactaaaaaatggattttttttggctttaacctttaagttgaaatcacaattagtggccttttcaccatagtcataagagtatcaaagtgtgtgtattcacccacacatcaaaccagtgtttactgagagtatattctgtgcaaagaattgtgcagtttgttatgaaaaatacagagacctcgctggggcccctaaggagctcatagtctagaaagggagacagatcattacacggcagggaaaatacaatatgtatgggagcatgtcacaaaggaagtgacatcgagctgaatcttaaaggaagagcaatgcttgaatgaatgaggacatccctgattgaaggaccagcataatgaacaaagaattttgccttatattactaagattccatcagatgttatgacgcaaacataagcatcatggtaatgaaattaatagtaaatttaaataaaaatgatcaaattaagacttttttggttttgtctattctaccttctcattttaattatgttgcaaagaaccatatacttagggtaaactggtcaatagctgtggccatggaatagaattataattcaatttaaaaggagtttaatagtctcatggtaaatgaataggttacagctgggcactgtggctcacacctgtagtcccagttctttgggaggcctaggtgggaagattgctggagaccagtagtttgagtccagcctgggcgacatagcaagaccctgtctctactaaaaaattaaaaaaatagttgggcgcagtggctcacgcctgtaatcacagcactttgggagaccacatgctggtcgagaccatcctggccaacatggagaaaccccatctctactaaaaatacaaaattagctggacgtggtggtgcatgcctgtaatcccagctactcaggaggctgaggcaggataattgcttgaacctggaaggcggaggttatggtgagtggagattgcgccattgcactccagcctgggcaacaggagtgaaactatgtttcaaaaaaaaaaaaaaattaaaaaattagccaggcatggtggcgtgtgcctgtagtcccagctacccaggaggctgaggtgagaggaccacctgagcccgagaggttgaggctgaagtgagctgtcatcacaccactgcactccaacctgggaaacagagtgagaacttgtctcaaagaaaaaaaaaaaagaatgttatgaatttagtatttttatacttcccctacaactctagtatctctgaggaaaagcctcaatcagaaaaatgatttgctttggggttttatcttttatcagtgataaatgtgaattgagaatagaaatctcaaaatgcaataatgatagtactttatatttcagtaggacttaatatataaaactctaatatgcattatttaaatttggccaatatgcaagagaaaagcaacatagggcagaattatgagtttgcttcgtaaaataactattaccagttcattctgttcaactatgtactggtagcatttgtaaacaattcattcttattttttttccaaagtgcattgcaaaatagtcttgcctgtattttcctgtttgcagtctatttcattaaatttctgcaattctaaattagaatagcatctaatagaccacatatgaaatgtgcttgctattaattcagacattttatggcatattcattagtcaaatccttagtatttatttatgaagtcacattactctgtccagtaattaacagaagtggatgaatatgcatctctaattttttttttagcaaaagaaatagcttacagtaagtatttataattacgtcagctcaatgtttacagcacttgaatggcgatatgtgtagtttctgtcatttagacttcatagataatttttgtacagaaatgctttgttgttgatgctttgcttccttcacacatatatcacagattaccgaaacaatcattagtccttcagttgcaacggataagactcttctttatccttaattttctgagctcctttctaggcattttatgttcttacacagatgctaatgctaattaatgctttaatatgaaagatactggcaaataaaactgttacattttacccataagttgtaaattcagcttagttgccctaacaatactgatagtgataatggctgtacaattaatatttatggagtgcttccagtatactgagctctgtgctaaacattttacttatgtagcttagttaactctcgtaacaaccctgtgaggtaggtgttattagcccgtttcacagatgaatttgtaatcattatgccttaccacatttaataataacattctctattaatcgtatatttcagatgcccagctctggaactttgcagtatgaaacgtgtgtgtatgtgtgtgatgtatatataatatataagtatgtatatataatatataaatgtagattatataatatatatgtgtgcgtgtatatacacacatttcttttttttgttgttgttaatttatgtgccacgctgctgtacgaaactctggggtactatgatgaggggatacctctttcttgcctttaagggacttaggttgtggtgggagagatggacttggttaaggaacaagtacaggaaaatatgataattgctttaatagggataggtacaggggttgtagaaaaatgagagaaaagggcccccacttcccagaaggtgtcagggagtttttcacagagaagcgtccccagccctgagacttgaagactgagtgagtttgaaaagatgatgtgtggggggaacagaagagagaagggtgtggagatgagggaaacaagatggggtcagggagctacagggagggacttggaggtgctgagggtcaagtgcagcaggaggagagacccggctggctggggtcagagctcaaggagccttgcatgttacccaaaggaatgtagatgtcatactctgtgtgctggaaaacgatttacagatgaatccaatcaacactaattaaatcagtatgattaagggatgaccttcctttcttcctaccttcctccctcccttcctccttccctccttctttggctcatttattcactcagaagattttattgagtgcccataatgtgcaaagctttccattgaatcccaaagatgaaaggaggggtgagagtggacacagttctccctttctggagtttattgattcgtgggggaaaacaagcattaatcaatgaatcaaccaaaaaatgtaaaagttacaaaatgactactataaccagggagggtcattctatacaagtgtgtcctaggaggtggtgacctggctgaggaagtctcccttgagaagaggactgagctgagagctgaaggagaaaagaatacaaggtcatttgatagaaggggtgggtgatttgaggagaagtcttagcaaggaggaagtcatgtgcaaaggctttaaggcctgggaaagcaaggtccttttaaggaattgaaagtaagccagccatgctgtagtgcaagttggaagagaatgcaggttttgggggccatgtttagaaatggaaagccactgcaatgccttaggcaggagccaaggaaggtagtagggtggcagggtggacgcggggagacgtgttagggggccagggaaagagtccagatgagccagggtggtgccggagaggagcggagggagttgaggagtatggctgcatggttgaatatggggcataatttgggagaggaagacgtcagagtgatgttgatgccatcactgagctaggaaacgtaggtgaggcagaatctattctgcttagatttccagaaaacattaggggatagatgaggatgacatcacaatggaatttaagctatttaagctcaaggttggccttgaaaaatgagtaggaattttctttttttttttttttagacagagttccgctgttgatgcccaggctgtagtgcaatggcacgatctcagcttactgcaacctctgcctcccaggttcaagcgattctcctgcctcagcctcccgggtcactgggattacaggcgcccaccaccatgcctggctagtttttttttttagtatagatggggtttcaccatgttggccaggctggtctcgaactcctgacctcaggtgatcctcccgccttggccccccaaagtgctggatttacaggcatgagccactgtgtccagctgaaaaatgagtaggaattttctaaatggcaaggagaggcaaagcatgttaatcaaagggagtgtcatatgcaaaggcagaggcataacaaaaatagtgcaaataaatgcctacacatatacaaaaggagagttattgtgggacccatacataattttgttgatttcttgatatgctcatatccattttgtgttgcagtgattctaagatctgtattagtatgtagactttgtgaacaggtaaacatgtttaagaattttttaagacatggctgtattagatatcgaaattcctctcttcattttcatatctttactttggaattcatatatgccttttgatgttatcatctgacttgtttctaatgaaatttagccgcttaggcaggacgtggattttaggtttctgcttagtgttttggcatctggatttgggattacttagcatttttaatttactaaaataaccaccaacttacactcagttgaaatatgaacatgtcggtttcacttgagcttgggaattaaaatcaaagtacagtcaaatccaaaacaaataatagtaattttaagactaggtgacataaccctctgggaaaaatgaggtgatagtgatttgatactttttttttttttgagacagagtcttgctttgtcaccaggctggagtgcagtggcatgatctcagctcactgcaaactctgccttccggttcaagtgattctcctgcctcagcttcctgagtagctgggattacgggcacgcaccaccatgcgtggctaatttttgtatttttagtagagatggggttacaccatgttggccaggatggtctcgatctcctgacctcatgatccgcccacctcagcctcccaaagtgctgggattacaggcatgagccaccatgccccagccccgatatgttttaatactaactacagaagtgttggtagaaagatcagccttgaagagatggtatagtactagaatcctaagcatgacctctgtgaactgttggcttaagtactggctttaacatccgttggctgtatttactgtcagttttcttgtcaataatgcagaggtaaacatgattcctggccacctcacagactgcagtggagtggggcaatgtgtgtaaagcccttagcacatggcccagaacatagtaaatgtttaatcaatgttcgtgatgaccttggccatcactgacatcatgtcttaactgagttattaacaaagaggcatgtgtagtttcaaaagtgaaagtgaggccggaatggtaaatacatgcactgaatttgcataattttgtggctagaaggagtcttagagaaagagagcatcaaattcagcaatgtttctgacattttctatgaagaactgactgcttgttatttcttagaaatcttagaatcattgagcagggaaggaggggcaggaacgggattattttgatagtggtgtcctcaaggggaggagatggggtgggaagcaacccctggccagaacccactcatccctggggatagggacctgctgtgtctctgcctgctgagtttttgacattctgatttaaaaaccttgtgtgtgtgtgtgtgtgtgtgtgcgcatgcttgcgtgtgtgcatgtgtgtgtgagagattatgcaatatgatgtttcccgtttctgtgacttcagcgaatgtgaatgaagaccacagaagcagcctaactcagtgagaatattgtttttataattacaggtctaggcgttttacactgagattctccactgccaccctttctactcaagcaaaatcttcgtgaaaagatctgctgcaaggaactgatagcttatggttctccattgtgatgaaagcacatggtacaggtaaacatctccaaaagctttaaaggaaaataattatcattgagttgtaaagtccccaagatagtggtgggggtgtatacatatctggtcacacaaacatacacacacaacatacacatgtctattcatgtagactccattttttcctactgtctcttttataaaaatggaacccttgcttttttatgggaaaggaaataacttctacttattttgaggtcactagttaggatagatgacaaggcattgctgataattctgaaggcatttataaatttatagatttataaattcacttagagagacaaacatcaaatggtagtagagattgtagaagtagtagagattattaagagtattgttcctcttaacaatataattctgaacatctttcatagcaacagatatttttctaccgtatagttattaatgattagtataccattgagtaaacattctaaaatttatttaatttatatcccttctaactggacagttagccgtttctaatttttttgcctttttattttcttgagatagggtctcactctgtcacccaggctggagtgcagtggcatgattttggctcattgcagcttccacctccaaggctcaagtgatcctcccacctcagcctcccaagtattaatagctgggactacaggtgcacatcaccatgcctggctaacttttgtattttttttttttatatagtgatgaggttttgccatgttgcccaggctggtctcaaactcgtgacctcaagcagtcttcccacctcagcctcccaaagtgttgggattacaggcgtgatccaccacacccagacattttattgctttcatgatgccaaaaatattcttatagctctgtattagttcccattacaaattatttccttaggctaatttcttagcagcatactggtaaatgtaagagttttcaagttttacggcttttggtaacttgttgccaaattactttcagtaaagtcataccagtttgtatttccagaggcagtttatgagagcgtctacttaatacagttttccaatgctgagaattttgaaaacaaaaagagttttttgctgactgattatgcaaaatggtgtttccatgtattttgggttttgggggtggggggggtcatttgtaagtcaagtaaattgtactgttttgtagaaccttcctccattagacagcagcatccttgaaacttaccagatttcgacatttcagaaataatattaaatccagaaggagtagaagggtcctagggaattttaagttcttcctttctggccaagtatttttagacaactatgaaatcactagatacaatcatttttcagtggaaagcataatttttcatttcttaaaaagagcaaaaaggtatttaataaaaaaattttattagatatgtatctgaagttatactgctcattagtttaaaaatatgtatgtgcctatatatgtatgtgtgtgtgtatatatatatatgtgtatatgtgtgtgtgtgtgtgtgtgtgtgtgtgtatatatatatatatatatatgtccaatatcgggaacatgattaaatataactatgttagtgccatatgatggaaaagctgtagataagattgcaagcttcaggctgcctgggctcaaattccagctctgctgttttcttgaagtgtgacattgggcaagttactttgcatgtaaaattcggataataatagtacccttctcccttgggtgttgctgcaaataatatatatgaaatgtttaaaatcgttaaaactcctatttcaggagtatttaatcatttgagaaaatgatcaatatagaagtaaacaaatgtagggtattggcatgaaccatagtataatcctaatcttccaaaattactttgcctctctttcctccctcttttcatcctcctctagtatctacaaaaagggtttagcatacttctgaatggatttaatttgtattagtggagtaatcccagtcctggagagacttcctgattcaagttttcaagtcagagacccatttttcacagagctttgaaaccatggctgtctggatcacctggctgggggcacccttggagcagccgttgggtgagagcagagcttccttcccagccagggctgcctagctcctgtggtacagcaagtgccttgggcacagagtccctcaccgtctggcaccatatgtgagctgccctagttggctcatctcttcccgtcattactaaataagcttcatttcactaaataaatgaaagagaaggtagatgaagagacccccccgccacacccagctcttaggaaacgcatgctttatcctacagatgcatgaaggggaaggctgtaggtttgtgaatctcttgaccctttggctccatcgtaacgttgaaaagtgaaaggaaaagtggtcaaagaatcatttggcatgaaggagacaaacacagaacgacgtgtacggcttcagcctctgcctttcactggttaccctgctatgagcttgtgtatgtagacgctgcattcgttttggccctaatttctggtctaatttgaacagctctgtatttctcagcagaagaggaatatctgaattcctaattaagacatgttagcttaagaatacctccttaatgtgtcataaatcattcccctgtgactatgaggatgaataagaaaacaaaacttggatttatacacacatgtatattatttcaacaaaattaataagttcatagagggagagaggacaacaaatgtgttagcaaatataggtcaggaaaagagttcataatgttctgccagattctgatgaggcacctcatgagtgtaggtagaaggcctcaagtaacggtagtgggaatggtaataacactaccatatggaacatttggtatttgaatagcacttagcttcctcccaaactacaaaatcaataaagactcagagaggaagaaaggattctcttgctgtggatcactggctggtgtgcagaaatgcagacgtgttggttgtcaagggcttaccagaataaatttctctagggagacaggagagtgggaaatacttaaccatattaattgtgctgtgacctcagatctgtggtcagcagtttttggttgtttccatatactgcacatggttgcccacaccatttttgcattcatgtacaagacctatctgcaagaccaggcagaatcattgttgaaatcttagttcgcaaagtcccatggggactttggggtgtcttaggattttgccagcacaaagttaaagcacaacttttgaattgtgagaaactgagacaaggtctttaattttaatcccattcagtcattcctcactcatttattaatttagcaaaggcctttttaggggcagctatgtcccagtatagggctgggcattgaagataatggaggaaaacaagattgacaaaagactggccctaatggagtttacagttctcagggagatacagtcaacaccatcataactggtttgggggaacaggggagatgaactggaccattctaaaaggaggcaagaggtgcatctgaaattggaaactggagaaaccaggggagacagacctgttgatctggaaggcatagaacagaaagaaccagagaatagtcagggactgacaatgaggttgtgattgttgacagccggaccaggccaggaaatgaagaaggtaaggagagaagcgtactgtctaacacccctcgaatgcacagttgctagggccagtaaagatcatcgggctactcatctctcaatttaggtaatgtaaatgatgcatcttattgacaatccatatccttaagaaattgtgaaatgagtcttttactttttataactctacaaacatgttagaaagatggatgtcaccgtgtctttatcacagtatggtgatttttcttaaccacccaaaggaagaatcgaggtgcaccagaacacgtgtaccttgttctcttattaaccatatcctttttcttactttacccactataattcacctcagagagtgagattaattatataattaatcctaccttttgtgcacatgcataattaactttatttagttcactttaaacagattttaggttccagatctaaataatagcccctccatttgtcacatcttgacctctttactatttggtacccttccactcagcattgtttgtgggattgtggttcttcttaccttcctccctccattcctgggtgcttttagtggtctcttaaataacaggctctgctcagagatttcttttatctccttaggccttgacctgcatttggtaaaggctgcatttttagcttcggatttactgtctttgacgaacctttttctctattgtatccctccctggtcagctgctctcttcgggccctcaaacatccaccacgtactctacccagatgttttcttctttctttaacatgtccagttgagttgcccatatcatcccctactccccatccacacacccacccagcacacacacacacacacacacgcgcgcacacacacacacacacacacacacacacagtgcattctcgaacatggggtcttttccccttcaggcaccgtatgtaacccaccccgcccctcagctcttaggaaatgtttcctttatcctacagaaacacaaaaagaaaaactgtagggttgtgagtccctctcaacccttcgactacatctatatcataaggttgaaaatgaaatgaaaaaggttgaaatgtacatttctaaggttaagaaaatcctactgatattaagtatttaaaacacagacttccccaaaatttatctttcagcataaatatgcccttcccttttctcccacccttccttcaatctgtagatagcctccataattcatagccagtttgggtaaaggcattattttgagacatttaatgatttttttaggaaaagcgaaaaaatgtagggtcaaagattcaagagtatattgtgttttatatgtaggcgtagcttttaaactattttggatactttaaagttttaaaataacttaccaggcttctttatgaagcattttattctttgaaagttttataaataatatgatttctggtgtcagtatggaaacattcacatagttgtaataactctcatgaaataaggtagactattccatcatctgtgtttactcttaaaacacattagaaaatggttgatatcaaagcttacaattttgtctttcttattgctaccctaaagcagactgctgcacagaccttcccctgctacactaatgctgctttcaatgttggcaaaccatactactcaaagtgcgggcaaaactcgaggtagaaatccaactttcatacagctttatcaaaatgacagtattctatggtacttttcaaatcactatttttttctcttagaggttatcaaatgaaatgaagcatttaaatatgttttctaaattcaggaatgtgagataggagagcttttgacattataggattcagcggtggaagagaaaatgaacatccagttccctttctccctaactcaagatctgtgctccctgaatatcattagtgcttctcatttcatcagtgttcaaatagtgaatcattcattcactgattgttgaaacaactgttataagatttggaaataatatacagaacatcttggaagtactttttttttattagcaagaagcagctatatgccaaaagtattaagaaggatcatctcttcagaataagtgagaagtatatcactggtaattttttagatttttgctgaatgttttagtaaaatttgggaaggtagtttttttttgagttggcaattatatgctgtccctcttgttttctcttccaaaataatcattcttctctctctctctctctctaaaatgggagccacagagccactgtcagaattgtatacatataaacctgagaacattgcctggcctggcacatagtcaatgctcaataaacatttcttgctactgtatctactgtgttctgttccccctctgttcaacaccctgtattttttcctggtggagattttcctgagtacctaaacaaataaacatagccaaacaaaacaagaattcagtgctgatgccgtgtgctttagaagctgggtctgtgcttgacttgactgacggagatgtgatactctgagtgtgtctgcagataaagccaaattcaaaattcaagtgaaacgcccttggacttgggaatgaatcggcgggtggggggggggggctttgaccaaggtactcagtgaccctgtgcttccaagttctccatctgtaacatgagtggtttgctctcagaggtttcttccacctctaaaaattaccatcattttgcaaccttgatgctttaagactttgaagtccctgtggaaaagaacctatgaaaagcggtcactgtttctgttttccccgtgcattttagtggctgcatagagtgttttttggtgtgtgtcttccatcttgctcaggtggagctaatgacctccttctccaggatagacaataaaacaaaccaaaacaaaaacactctgttcatgcacaaaggcaaccctcttccagatgcttaaccccttaaatgagtatttcgatgacacagagggatcatcacttcacttgccactgaaatacagccatctctggagtgaaatttggcagctgggaagtagtcaagctgcagtacttatatgacagtttggggaaaaggagtgagacagaaatagcagattccaaaataatcccattaaaacagcagggaaagtggaattgggcaataagatgggaggatggtttgccccaaagtctgactgtcctgtttagacaatgcggacttcagccccagaagctctaacttgtgtcactgctggaatatagtgaccacagtcaagaatcccctacacacaccccaaaaaggggggcttatctaatgtcccattgatctatcgtcttgtgatttttttttttttctctttttcctgctactctagttatcaggctgtgctggcacataaatggatctgtctttttaaagctacctcttccttttgccccctgcataagatagtgttgtaggtaagcatgttataacatcagaaagtactcagctgagaaggagtgatgttaaagcaccctttgggctggctctggaaggatgaactgactgaccagaaaggaaaactcttctgtttaattccaggatcttgggaataacagtgacagagaaagaagattcgagaagtagatgtggttgagtacaaatgtagaactcttcagattttctggaatggggtagccattgtgataaatattaggatatgagcgtggaagtcgtagtggataaatttgaaagctactcagcaatatgtgcagcaacagtttttaaaaagcaaaaggaagatttgtcaacatagttagaaatcctcagatcctcagataatggaacatcatatctctcaaaaggaagattccagggaataaagaaagcagatgataagggaacctgggcattttagtttaaccagaaaatagaacgttaccaaaaaatttagagattaaagagtcagtttcatttagaagcacataaaatgtttatgtaatgagcagaatttatagagtctactattataaaatagaaccaaaaatgaattcaagaaaaatgtaataaaattaatgtagtgggagaaaatgaaatacaatatcagaaattctagttttgaatctcagttctgcaacttatcagctttgtgaccttagggaaatcactcaaaatctgagggttttttccgcatctctataaaatagaaataattataatatctgtctcacaggggtattgtgatgatcaaatgagataatgcattgaaaatgttttgtaaattgtagagccctctacatatgctatttctataactctgcaatttcttatggcatggagtgagctctcagagacagtaatcacatgtggaaatagcttagagaagcagtcatatcagaggcaaaatctattgtataaaaatttaaaaattcatatgaattattttttctgcttctcatttttctggctcagaaattcttctatgtttacagaatttttccaaaaatattctggtaagccctgtaacagaattgtccactctctgttaagcggtaaaccacatgattttttttccttttttttttttttttttgagacagagtcttgctctgttgcccaagctggagtgcaatggcacgatctcggctcactgcaacctctgcctcccaggttcaagcaatccttttgcctcagcttcccaagtagctgggactacaggtgtgcgccactgcacctggctaatttttgtatttttagtagagatggggtttcactatgttggctaggctggtctcgaactcctggcctcaggtgatccaccctcctcggcctcccaaagggctgggattgcaggcatgagccaccgtgcccggccaaaccacaagattttatagtaaatattgcctgtgagtaaaccttgaataacaacattaaagcagaagactgctatcttgtgtcatttgataatcctaatttagggaggtctgggcagagaaaagcggggtgtgtctgtggtctggggacaagagtaatgtaagtagcatgccacatgatgaagactgaaacggagacagtgaagcacggtaaatctttactgagtgtgggctggtgtgctgaagttccctttatgcatcagcccatctgtctcattagcttctctcttaatcacaggctccatgaagtgtctacttgtctttttttagctttttatgtcaatctcctataaaagcaaaaggaagtcaactggcctttatgctgtttgtgtatactccatgcatgctcggggtggggccagctgtatttataaatgcatgctaacatgggggttactctgtgtgcataagagcttatttgtatgtgcattcatgaatatgtgtacatttgggcagatacacaaagacacaacacatatgtgcctctgctgtatgctctcttacatggaaaagacacattgacattaattagaaaaggtgatatgaaacagtgaaagtaaaattcctttcggcagtatttactattgtaattaaagtgcatgatgtaacattatatgtgcaggagaatttgcttattcatcctttagaacaatagtaggagttacatattaacaggtttaagtgtcaataagtgtctgaatacagattctctattgtgtgcagttcttgtaataaggcagtgtattttccttgtgtctttgcttgcttggaattgaaaatgctttggatgaagaatgttgcagagtgtaatttgtggcagaaaatatgcccccactgtttgtttattattcctgaggacatttgctgggctgaactatcatatgtagaaaagaacagctttgtttggaaaatactgtaagagcagtacaagaaaattgaattaagtaaagagacttagggagtccatctttctctgatgatattccttatttgctcttcattattccctgtgaaggaataaaaacgatgaaattggatttgaagactggattaagacaaatgacttttcagatttttttttttttaccttagctgtttccaattttcctagaaaagcacatagtcactatataaagagtctgagtttattgcattaaatcttcctaaatagtgtgcccttgaggtttgatgtggggaattagtttagaagattcaggggcttggagtacctgctaactgtgtgatggcgtgtgtctctagaaattttatatgcccattgatttttatagagcaagcagtacaatagaagggaagcaggatgctgcttggtcttaaggaagtctttcctgcctaccaattgccacacccctttttctccaggtagagttgactatgttttcttctgggccattgctgtacttgcctaatacttttaataaggacttgcaaatgtgcctgtaggtctcttctaactaggctgtaaaccactcggacagaggaattgttttatttcttgtaactctaacacctaacacaaggccctcaagataacctgtcaaatgaatgaacagatgagctgaatacccgctgtgtgcctgttcttgtcttaagacatgagggacaacctgtaacacaggacacaatgtggctgtgtctgctctgaaatggtagaatatctagctacagcttagaataactgggtaaggaaataaatgctggattataacccaaagaataaaatatccaacgagtccaatgaataaataaataagggaaaaggaatgactcttccctgcagcagaatttcagttaataaacaaacgaggaaggaagcagtatgaaaacatcattagaactcatagtaagaattgccacgagaaagtcccaccgatggatgcattagatgggcagatgtggattagatggattagaatgagcgggcaaaagtatatgcagaaacaggaaattcgtagaattttaaaatatccctaccccaaacatttagtaattacaaggagaaaaataaaagtttacggtgaagaatcctggcagacatcaccttaactgagtgatcaaggttaatgtcaccagtgatacatattgacatcgtgtgtcccactgagaagggcgtgtcatctctgatatcctccctgaaaaggcataatctcactctaatcaagaaaaaaatagcaaactcaaatggaaggacattcgaaaaaataactgacccctccccttaaaattgtcaaggtctttaaggataaggaaggattcaggaactgtcacagattagcagaaactaagaaatatgaccacataaaattctaagtatgatcctgaaacaggaaaaaaaaaaaaaaagcctgtttggtgcaaaaactggtgaaatcctaatacaccctacggtttgttgagtagtcgtgacccaggttaactttctagttttgatcgtggttctatggctttgtaagctgttaatatagggggaaactgggtggaaggtacaagggagctctgtactatttttgccgctttctgtaaatctaaaattatcttcaaaaaaacctagttgacacttaggtaggccgaggtgggcagatcacttgaggtcaggagatcgagaccagactggccaacatggtgaaaccccatctctactgaaaatacaaaaattaggccgggtgcggtggctcatgcctgtaatcccaacactttgggaggccgaggcgggcggatcacctgaggtcgggagttcgagaccaccctgagcaacatggagaaaccccgtttctactaaaaatacaaataaaattagctgggcatggtggcgcatgcctgtaatcccagctactcaagaggctgaggcaggagaagcacttgaaccccggaggcagaggttgcagtgagccgagatcgcgccactgcatgccagcctgggcgacagagcgagactccgtctcaaataaataaataaataaataatacaaaaattagctaggcatggtggtgtgtacctgtaatcccagctacttgggaggctgaggcaagagaattgcttgaacctggaaggcagaggttgcagtgagctgagatccggccactgcactccagcctgggtgacagagtgagactccatcaaaaaacaaaacaaaacaaaaaatctagttcagggcacaataccaatccacaggaagcaattatagagcaatccatgacaacagacaactgagaatttgtaatggggtgccagtgtcaggttcagaagaggaatgagaaatggctggggattggagtcttcaggaagagcttcctatgagaagcaaagcctgacagggaccttaacaggatgtgtagtgatgatgggtggaggaaactgaggggtcattgtaggcacagtggcagcagggacaaaagcatgaggaagggacacagatggcctgcatgggatatgttggaggggccagcggagttatatgtgcattgctggagattggtatgaaagagaatttgacagctgtggggataacagagctaaaggatcactaagacctggcggaggaatgtgaagttaatgcaggaggtgacacagagttcccagttcttgtttatggaaggggctcagtgagtttgtgtgtatatatctgaaaccggtgacaatgtatgtagggtggccagagttgggagaaacaggggacaggcgagtcaggaattaaagataggtaatgggagcctattcgtttgagggtgttgggaggatggcaggaaaggaaaagggggcaacatattcaaaggtatttgaagggataaaataatataacttagtaattgttggatttggagaatggagaggaaggagtcaaagatgatttctgggtcatatttactggacaggtactattggtgtccataactgaaataatccattcagcagatatttgcatgcctacatcgaggaataatgtattctaggtgaggaaggaggattaaaaagaatgtcaacacagcatctgcttacgctggaatgtgggccagaaagcctgtggcttaggctagactgaatgaatggccaggtcagcctacttaaggagtccctgccctccacataaaaagaagggaaagattgccctactctgttcctagcagtagccatgaacagtgttagaagatctttcaaactgacacttctgtcctcttgataaaaatgtcaggtctactgttggaccatactcataaaaactctgttaaatcaccattctacttaggaaaaggccattcatgccccacttaactctgccaagatagaggatgctgtgttcccaaggtaccaaaactgaaagttaaaatgccataaaagtatactgaactttatagaagaaaaaacagaaaaagtgtatgcatgcttaaacctcaaactcttgatcttcaggtaccatgtcttttcaacgtagataatatcacctagtgagcacaccctgaagtcatgctctggctggctttgctgtgttctttttgttttctcttgggcttgtgtctcactctgtgttgggtaggaaagggtttctgtagcctttatacccttgttttcatcacttatttcacgaatttccacttattactcaagaataaccatatttttttatctctatgacaagctgaaaacctccctgtcagcaattatagcctgttagccctcacagagtcagtcttggggaggtatggccttgcggttcaggggcagaaccgtaggtgtattcacctgtggaagacttagacatacacatttgattatgggtggcagtaatcagatttatgttttgaaggtcttcgaagatctccgtccctttctcagtcaacattatacatcattgtttcttaacagttgagtccttataccttttttggtatcagtcggtcattaggccaagtaaacattttattgacaataggcaactgaggagaaaattaaccctttttatagttaattgtaagtggaagttgcttgatattcttaaaaatatgaaattgtggaagttctggttctagtctgagaattgagcattgagcatcacctttacaacatgtagacttaaacttcaaatacctttatgatgctgagaactccccatggaataggaaccggccatggcatatctaaaacatgacttacatagcattgcacgatataatatgaatgcatgtttttttgtagaatttagaaagaggctgaacgtgatggctcacccctgcaatcccagcactttggggggctgaggtggaaggatcacttgaagccacgagtttgagaccagcctggacagcgtagtgagaccctatctctacaaaaaaaatttaaaacttagctgagcatggtggcatgagcctgtagtcctagctacttgggaggcttatgtaggaggatcacttgagtctaggagtttgaggctgcagtgagctgtgatcgcaccactacactccagcctgggtgacagaacaagtctttgtctctttaagttttttttttttaattagctgagtgtaatgttgtgagtctgtagtcctagctgctcaggaggctgaggtgggaggattgcttgagcccaggagttcaaggttacagtgagctatgattgcaccactgcacaccagtctgggtggcaaagtgagaccctgtctctagaaaaataaaataaaagaaaataatgtataaaagaatgacatcttttgtagagcggacattggaaatggcagaatactccatgaagtagcctctagattccctttatgggcttgctgtggaagcacatatgttcacattggcagaataaagactctttttatgtccttttaaactaatgtattgacttcagtattttttttatagggaacatatttcaaaattgtaatggtagtcaatggttctatgtaaaaatactttgtctttccacagacccatatataccagccaggtcaccttcattctcagagtgcctgatgagtagagtgcattcaatacaatagctgtcttgtttttttagcagcagaagtgggagtcacatgctgaactcgggaaccattttgaatttattctcatagcaattgcaaggtaaaggcaggcagaatccttgctgtgtaaccctcaacagagctccataaggattgggaaatcaggccatgctttgtcaaagagagggtgcacacaggcatcaaacaggtcacttctcttaattcttaggccaccacacaggaagcacataattatttaatccctggatctttctagagatgcaacaaagtgatgagggtggacagctccagaaaatcgctgtgcaaggagcaagggtagaaagctagggttttggattagacagactccatttcaaattacatcttaacttagtttttattgtaccctctaacaacttatgaataaaataaggggaatatatagagagttaggcgtggggaatggttacaacttatttctcttcttcactttcatctgtctttcttcagtctcttctcccctcttccattaaaggtaaactgaataaatgaatagtgaatgaatgaagtgagcaagctgttttcaacaaagttcacttggtgccacttccatggatttagttataaaagtgatatgatcctagttatcttaggcagaatacatatttctgtgaccctaatctacgtgggtcctacttgaaacctggaaatgataggaaaaaccttcttgggaaggagaaaaatgaccaataaaaaaattctgaattatacttatagatgaagccctggtgaacccagagccctgttgactcacaaggacactcaaagtaagattagtgattcaacacattcacttcttcagtttcccaaatagattagaaggaataagagggctttcttgggttaaacttactaaccacagtgaaggaaggagaaaacctataaaaacttgaagtattataaaatctcagcggtgtgaggccatttcgtttgaggacaaacaaacctagtggattgtccagggcaggtgaatgtaaaggacatttcctgagatgcaacaaagagatgatggtacaatgggcaaggatgttgcaataacaagcaaccccaactcttcagggtggaacacagtagaagttcctttttgatggtgttacggataacttggggtgttctgcagttggagagggcgtctgtatggtggtgattccctgacccagggtccttgtatcgcaaggctcagacattccctcagtgttgggagaccctaaggatcttctgcacctggcagaagagagaagtggggaagcgagagagtgagcagtctcctgggaggtttgttggtgaaattggcatataccacttccttccatgttcccttgaccagaatttagtcatgtggacatagtcaactgcaggtaaagtggagaattgtcagcctgtatgtcaaggagtacagggaaactgttttttcaacaactaaccagtttctgccacaactggataccttcctgacgtcatctttactcccatcccagccccacccgagatttggccatgagtaccctgtaatttgcagggcattatatctctgtctcaggaacagcaggagaccactgagtcaatcggaactgttttttttttttttttttctgagacggagtctcactctgtcgcccaggctggagtgcagtggtgtgagcttggctcactacagcctccacctcctgggttcaagcgattctcctgtcttagcctccccagtagctaggattacaaggctcacaccaccatgcccagctaaattttttattttttatttttagcagagacgaggtttcaccatgttggtcaggctggtctcgaactcctgacctcaggtgatccgcccaccttggcctcccaaagtgctgggattacaggcgtgagccaccaccacgccaggccaggactcttcatcttttaaaccacccgggtctgaactgacagtcccttatgttatcttcatgggaagaagagcaggcagtcatgtgtggctccccatgaaaaggcaaggaaccttctagatactgccgctagaaaccaggtgtgggatagaagccctgcctttgatctatacctgttggtcaggaacctgcttctactttacttcattcatctgcacttcttaggagctgggtcctgttcttgtttaccattactaaattacggggaaattcctgaaattatccagtcctcccagatggttcattctttgtgtgtatacccagagcttggtcatgtccccattcctctctctcaagattagatctgctgtcaaaacctagaaacaagtctttactgaactgaactctttattagcctttgattgccagataactggacttgggaaggggagtttgggaaaaagggttaactatattaaatttttttggtgctctcttatatgggctgggatgaagcatttagacagtgggagaagtataggagaggcagacagatgccagaaaaaaaaaactttggttgtttccaggtaccgaaaaagaaagttcatttgtaagtcacccacctcctcatgatttcttcacctcctgtcccctgctcatggtactagagtttgtctatattataagctctatagctctttttgccttcctgcaaaactaagcactatttataacactgtttctctgagaaaatgtgtttggagtttcaaataaatgacttacaaatgaactttctgtatacaactcattcatacattgagaactgcctgtaccgggcatgtaacctggagataacttttatctctgctttatcaatatgggcttgtcaggttgacttatgtgtacttctctctgccttcgttttgatgatagcctctctcttaaaatttaatactctctttatgtttggagaaacattccctttggcagcgtttcaaatattcttgcgaattggaatagtgattttattttatctcccaatgtatctttaataggattcatggctatgaaaatcttttgcacagtccgcctataaattgtagaaaaattgagaactatttaaaagaagggggcgcagaaataatccttttctagtattactctgggttgtcagatatctttgcaatataattactgtgttggtttttaaaggttaaaagagctctgacgtttataattctcttttgtgtgtgtgttctacacatataaggggaaaatctaacacatggaaggaaaatactttagttaacataaaggtcctgagcattttatggtttttcaatacagagacataattcatggattttatatttgcttttacagatatctggtgaatcagttatttgctctgtggaaccaatttgcagtttacacaccttgtttatttctaagctgtgtgcatgggtaatgtgtgcacaaaaatactcttgctgacattagattgtaaagtaaaaaggcggaacactggtcctggagatatgccttctcagggaacttactatccatatacaagtaaaaatttctcattgttagcagagcagctgacagaatatgatcacaaatgttgctgatgctgttctgttaggaggtagaaatagaatgcctaggactatgcaagcttgtcagagttagattgtcagggtgatgtgcttccatattaaaaagaatactttgttcccccctcacacatgcacccttgcagtggaaagaaacatttatttcagaataagcgcaagttattctgacttgcactcacaggctcagactttgatgccagtgtagttaaaatttagtgaataccagtcatgtttaatggtctttcccttctgtttaaaacagtactgcagcccatgcaagaaacatttccctttaattttatgcattttgtggtatcttttgatggtttttctctactgtcaaaactgtgagaataatttcaatggcatgttttttctgccatcttcagttggcagtcatatccccccagattgtcctcatagattccagatcacctttatgtttaatcttcattaattgacaagtacctttgaaagggttttgcaaaaattgaactgcaaagctgtgatttaatacaaggaaggctacatcagtgtgaaagaaagcactttatgaactgtagagtactatttaaaggtgaggcattataattaaatatgctcaggttgttactgagcattgaatgccaaagcatatgaaagacaacttacgatgccaggagtttgagactagcctaggcaacacagtgaggacccacctctacaaaatgtttttgttgttgttgttgttgttgttgtttttgagacggagtctcactctgttgcccaggctggagtgcagtggtgtgatctcggctcactgcaacctttgcctcccagattcaagcgattctcctgcctcagcctcccgagtagctgagattacaggaacccaccaccatgcccggctaatttttttttgtatttttagtagagacggggtttcacagtgttcgccaggatggtcttgatctcctgacctcgtgatccgcccgccgtggcctcccaaagtgctgggattacagtcgtgagccaccgcgcccagcctgtttgtttgtttgtttgtttgttttttaattggccaggcatggtgagatgtgcttatagtccagctactctggaggctgaggcgggaggatcgcttgagcccaggagtttgagattacagcaatgttatgagagtagctagaagttacaccaatgctgcaggagtttgggggaatccagagttgtaaaatgccaacaaaaattattaattaaggggatctcttagccgtctctttgaccctacaaaaaacatggtggtactgagttttttagcctcacccaagcaaaaacagaatagggcattgtatttcttatatctggatgcaaaaacatgaaatgttaattgtagattataagtcattaagtgtcacggatttatgttttatgacaagttggagtttacagatttctaggctatttttttcacatagagatacatgaaagctttattcttgttattcaacgtaaatcttttataatctgctctcaatttccagtatcctgaaaaatcctttttctctcttttttgagacccttccctccccctaccatccagagtcatgcagttaacagttctgatagtgcttggattcatttgtagattgtacataccaaatggagctggcacctcttcatggaaattggacccagtgggctattttacacttgccggatgtgctttcctcagtagaagtttatattttatagctgatactccattgaccatagtaacctgttataaaacatgatgttttatcatttgttctgtgtcttcagggctgaacattttatggagagactttattaacatttaaagagactttattaaccctagatattaacatggtttacctggaaattttttgagcaatgttttcatttgattcctggaatgttcaaatagcaaaggcagtttctgttggtgtgcatgtgtgtgtttgtggttaaaagccagcattacccagagaccttctggttcatgtggaaattattattattactatgattattgttatttttgcaaatgaataaattgtcattctgatttttttaacctcaacgttcctttaaaaacactgttgatttttatggagaaggttgatttcctggaagtaataatatgatgttagagattactttttaggcaatattttggcatgtttatcagataaatcaaacatcaaataaatagattatggggaatgatttttcagtaatctctttttgcagtttcttccctaaacaaaatgatgtggcctattaggtggattggtttggaggacaattgcttacagggaccctgtccttatggtgtggagaagcagaaaaaactcacagtactccagagtagcccccttattctttttcataaacttcaaactaggtatgaaagacctgtccactttaaagctttcgcctgtgaagataaagcagagattgatttttaaccactatgctcatatggggaaacagaatgcaggagctaagatttaaagaagcagatgggaagaagagaaataacctcctctggcatccacctggaaatgtctcctgagaaagaggatggacatcttctgatattcataagtcaaggaactgcttgaattctgtattccgtgtacagtattctacctatcaagaccctcacccagggaagaaagtcttgtttattcaggagatggggagcaggaggcattgaggactgcatagcttatttaaattaaaaaaaaaagtgcaatgaattgctttttagtgtatttacagagctgtgcagctatcaccacaataaattttagaacattttcatcacccctaaaggaaatcccatacccatcagcaatcacttcccattttcccccaatcctctaccctcagctcctggcaaccacgaagctgtttctctatatatagatttgcttgttctagacattccatataaatagaatcatgcaatatgcggacttctgtgactgacttctttcacttagcataatgctttcaaggatcatccacatttcagcatacatcagtcattcatttcttgttatgatggaataatgtaacattgtatggctataccttattttgtttattcatttatcagttgatggacatttgggttgtctccactctttcactattatgaacagtgctgctatgaacattcctttccaagtttttgtgtagacatagtttcatttctctgtgcagcctacttttaggtagttacaaattaagattgtaagtgatttttttttcattttacacatttgttcgcttcacgatggcctcctctctcttcttacctatctcactctcccaaaaatgatttttcttgagaacatagttgtagaagggtaagaatatcaaccaacttttgctaagtatgaatgcccaggcgctctgctaagcatcatgtatgtgttacaatgtttctcactttatagacgggggctgaggtttagagaggctgctaagcctggaggtcattcagctgaaaaggtagaagagctgggatttggacccacatcctgtttactcagcaaggtccatgctgtctgttgactccctcatgatatgatcccagatcatacacctgttgaaatcttagagaattctctttctattcgtgagcttctcccaattgtatcctaaaaagtaaggaatataaatcagatgctccgtcctaagcccttggacctggagcgggcatttgtgttccccgttgacaaaaagatgatgaaatacttcctctgtgtctgagtgcagcggcgtcatggaccggtgttaagtttaacctgacccttctctctgccctgcagttgcttcatctcctcaccttaagacttcacctttccttcatttcagcttcccagagatactgccacaccccggacctgtgtatcaacttgaaccctcacaccccccaacttggacctttctaaatcttaaaatctcagactctgtagttctctctgggcatagcctcctgacccccttgctttccctctcttcctcagaactcagttgtctccttattgtgagccctgactcatcccccactcttggtcactatagccactttcttcaggctccgtattcctgccccctaaccagcctagacctcatggcttgaaagtttaactgtgcatgcccaatagcttagtgccatgcattcctttccaggcaccaatcctgcatgatccccatcacctgcacagctgcttagaggcccccaaacccaactgatgggtcctgatgtaaattcttactgttaatctgaggagagtcatcattgcttttctagtgggctcatagtcacatttcttatgggatctattccaaacttttccagtctcttcaaaacttaccctcaccctcactttggtagaggaccatttattcatcttgcttttttaaaatcttgaagaatccaggcatgaatccttctactctctttttccctttaattctgtccgttgctcctgtctcacagttgcagacaagtgttgcatgctgtgctcacgcatcccagaggagcaagaagacctcccactccgcaaggctccaagacccctcgttttctggatccctctctaccctgacttctctgaggctttgtcacctaggttatctccctctcctgcttgatctttcattatcttcatcttaaccaaaaccttctcttcagtctatgaatgtgcctagtggtgtggcctgtcttttaaaaactaaaggagcccttattttgaccttgttctcctcaggcaatttccatttctctattctttctttaacctcaacatgttttgaaaacatagtctgtgttctattcatccagattattaccacccactgaagtcttagtcaccagttcttctctgtcatccaagcactggaaacttctcggcccaatgtcttcactggcctaagatggactcaaactagtaagcttttattcagtggttactcctagacctctgggctgtatttcctacggtggctgctgccagccatttcatttcttttcttttctttttcttttgtttcttttcttttctttttcctttcctttcctttcctttcctctcctctcctctcctctcctctcctctccttttctttcttttcttttcttctccttccccttccccattccccttctttcttctttcttcttcttctttttttttttttttgagacaagatctagctctgttgcccaggctggagtacagtggggtgatcttggctcactgcaacctctgcctcccgggctcaagtgatcttcccatctcagcctcccaaatagctgggactacaggtgcaggccaccacacctggctaatttttgtattttttgtagaggcagggttttgctgtgttgcccaggctggtctccaactctgagctcaagcaatccgcctgcctcggcctcccaaagtgctgggattacaggtgtgagccactgcatcagcctatttgtttctgaaaacactctttatctgcctttattttctcttaccctctactgctctgatcatttcttctttatgtcttccttcttttgtcccttttcgtacttattcttaaaagtagattctgcctaagtgtgtataaccacttttcttccttgtttacatcttccaggtcctgagggagtgttgtgacttggttacagcctaccttcctaaccttactcattgcagcccaggcttccccataattatatacatgttcctctcacacctcaagctcccttggttttctgcttctgttgcatctctggtttctttcacctaggatcatcctcctgcctcccctctctgcatttctatatattcttttccaggaccacatcaaattctgtgttctccttatgacataatctcaaatgaccccaggaagttatcttttttttggtccacatttttaatgggacctttcttacttttacttggttttcaaattatttgttgaaacacatttcttttaaactatgtactcatgagacagtatattgagaatttaacccctgtccttaaacacagtaaatattgtgtcaatgtttgctaaatgaaaggagtgaaaagtatggctctatgggaacttgttggtgaatgtcccatttttatttaccaatgaagaaaagcaaaacttagcaaaatgtatctgtggagaggtgggtgggagagggttgttgtatagtctgaaccaaaataattaactcctgtaattgcaaaaatattatcattgctcagtgcaccattttgcagttaatcagatagttttagggaaatattaaatgattctcaagcttggaaaatagcaatgagtgttatggcatcactatacagcccagaatgaactcatggatcctccaatctcttgtatcagatatactgcatactggatacccaaggcatcagggattcagagaaatttttccgaaggtcatctgggtaggaagcctgacttttatagaatatttcataaaattctttttattttatttttcaatagtttctctacattgtatacaaagcacactaattactcactcccattgtctccactaattacatcactcccattttgttctcctatgaacaaagaagaaaggaacaagaggttgttttttcattttgaagaggcaaggttgatatgtttgactaaaataaagttgggattacctgtgaatttcagccagctttgccctccggtccatcaggtggacagtggaaaattgactgtgatgctaaaaatggtcataattgggggaaagtaagctttaccacctcttttgtgatgctgaatgtgtcttcaagggaatcaaaaaagttgtgcttgacaggcaaggtgaaaaacccagggatttgctacaagaatctctgcaggagtggtagaatgagaagcttcattggagtctgggacattttagtgttgctggcccattaccctgaacactcttctaacctcctccaagacgggtgtctgagaggagctgggccctgcagaccaattctagtcttctctctccacccctgccccctttagaacaagcatattaaaggaatgtctgatgagctcactatagtctttgtcaggacattttattttttatttttttatttttatttttgaggtggagtttcgctcttgctatccaaactggagtgcaatggtgtgatctcggtgcactgcaacctccgcctccccgtttaaacgattctcctgcctcagcctcccgagtagctgggattacaagcacctgccaccatgcccagcaaatttttgtatttttagtagagacggggtttcaccatgttggccaggctggtctccagctcctgtcaggacatttttacagctgttttcgttctaaccctaactgatgaccattggaagacctaaaaattcagctacgcagaataagtaaaattggtctttttctttgcatcctgaggataaatctaaacaaacccctctcgttggcatatctccagctacaacagagggcaaatttgaatggattatgaagattgaattatccacttggtcttggaggtggtcccgtctcctgtgatggtggggtggggaggcggtgcagacatgtgtacaggaagcttagccaaatgcctctatttgggaaaagttgaaatcagtttcctgggcagtcaattttgagggtttaaaaaactttattttttttttattaaacatactaaaaataacaaagctatccaaaattagaccacgtactttgctccttttatatttcagtgtccttggtatgcttggtttcttttctttctttttgaagcattaatattgttttgaattgctagatatacagaaggtacgatagatgtacaaggaaaaataagcatctctcttatttctgtgtctaagtcacttgaattctcacctagaagcaagtaccattatcattttcttgtgagtccttttaaggatattttatgattatataagcaaaaatataggttttttaaaacaatgtttacaccccatacactattctgccctttacctcttttcacctaacagtgtgtcctggaaaacctttcttatcggaacatagaacagccttattcttttttagtatctaaatagtattcgattgtatgattttgccataaagtattcagtcccacattgatggactttttttttttttttggttgtttccagtcacttgctactatgaacaatgcttcagtgaacaactctctataaatagcatgttgtatgtcagcaaggatctctggaggagaaattactaaaggggaattgttggatcaaaaggaatatgcagttttaattttggtaaaccttgccaaattgccctccaatttggcattcgtcctattgtatgttcctgctagcactgtttgagtgtgcttttctccacagacgatgtttttaaacttcacgatctttgccaatctgagaggtgaaaactactatattctagtagctttaatatgggtttctgttattatagtggtggttgaatatactttcatatgtttaaaagccgttcctattttcttttctgggaaatgtatattcatcctcgttgcccatttttctactacgtttttggtttatcctgtgaattgacttttttttttaggagcatgtaacagctaaaaagattagtccttttgtcttatgctattttagtttaaatttttccgtttgtcttttgactttatgttttcttcatgcagggttttaaaaaattaaagtcatcttatttatcagatttttattttttggcttttaatttttttacatacttaggtctcttctacgcagtaattataatttttaaattgtctcgtattttttattagtattttaaaaataatagttttggccaggcacaatggttcatgcctgtaatcccagcactttgggaggccaaggcgagagcatcacttgaggccaggagttagagaccagtctggacaacacagggagaccctgtttttacataataataataataaatagccaaacatggtggcgcacgcctgtttgtactcgggaggctgaggtggaaggattgtttgagcccaggagtttgagactgcagtgagttatggtcgtgctactacactccagcctgggtgacagagtgagaccctgtctctaaaagaaaataaaaattaaaaaggttttattgagatatgattcatatatcgtaaaacttaccttttttttttcttttttttttttttttttgacacaggatctcgctctgtcacccaggctggagtgcagtggtgcagtcacagcttactgcaacctggaactcctgggctcaagcagcctcctgccttagccttctaaagtgctaggattacaggtgtgagccactgtgcccagccacaatgcagtcttttaataaatgggtttttaatctattcatagaattatacaatcatcatcaaaacctaattttacattttcattactccaaaaagaaaacctttacccattaagcacccactcccccatttcctctaccttctggcccctggtatccacttaatctatgttttatctctatggatttgcctgtcctagacatctcatataaatggaaccatataatgtgtggccttacacaactgacttttccacttagcgtaatgttttcaaggttctttctcatatttttatgctttcattttttacgttcaaatctttggtcaccttgggatttattttagtgcaggatgtgaattagggatctatatttttttaggtggccgtccaattattggaagtccttcctcccactaaagtgcagtgacacccatatcattcactgaagtccagtattcatttggatcgacctcttttctgttgaccttgctaagtattcctgtgcccatgcacactgttttactttctaaggctttataatatttttaatatcggtatggtattcttttcttatttctttttatatcattgttatggccattctttcctgtttatttttccataggaacttcagaattagctttctaatttgtatttttgacatcatataagtttatagataaatatagaaagaattattctcttgatattgactttctattcaagaagaagatagacctttgcagttgttcctatctcctcctctgtccctcagtagtatttaacattcttctttatgtagatttgttttttttttttttttttttgaaatggggtttcactctgtttcccaggctaaagtgcagtggcacaatcttggctcactgaaacctctggctcccaggttcaagcgattcttgtgccttagcctccccagtaactgggactacaggtgtctgccaccacacctggctaatttttttgtatttttagtagagacggcgttttaccatgtttggttaggctggtctcgaactcctgacctcaagtgatctgcccacctcgccctcccaaagtgctggaataataggcctgagccactgcacccagccctctttatgtagatcttgcatatagtcctccttcagtttatccctaggcattttatatttttgttgttatttaaatatgggatacctttttactggttgtcctttagaaaggttattgatttttgtatattcttttgtttcagttaccctacagaattctctaattaataagttgttcaattgacttgctcagatcatagcatttataaataataatttttctgcctgttataatttttatatcccttatttatttctcttatgcagttaaattggctaagtttaacagatcagtgttaaataacagagatgatggtagacatcctcatgttgttcctatttttaatgggatgcttctcatgttcccccattaacagtgagcctgcctttggggtggagcctgtttattgtccatttggcgtttgtagggcttttataatgagtagaaaacgttttggaaatgctgaatctgacggaattatttgcagaaaggtaaagtatgctgtgttagttctcccgcagtgataaaatagtagtctgatttttcttaccagcattgacaggagtttatgagtgggaagtctgtgctataaaggaagaaggcagcaattgtattttaatctcatgctatttttcttttgccaacgaagtaaaaagactaagaagctataggaatatgtagtaaaggcttttgctaagagagaaaaggaagaaaggtggaagaatgggatggaagaaacgagataaaagtatacctcattttcctcagcgtccccccagatcaagtcacctgataaaccaaatattactagggtagtttttttccccaaaatattattaccaaaaaatgacacaaaacactaattgtcaaccaaaatgataaagagtctccgaaaaggcttgcaagaaaatagtgaaatattttatcatttgtaagcaaaagataataatacagagttccaaatactgagaaaccacaagaggaaaaagaatgcctattgaaacatgtttatatgttgattctttttgatggtgccattaaagaaaaaagaatgttttgatctcttgcaaagaaagccaaactagagaggtattttatgagctaaccccaaacctgacattactctagtaataaataccaggacaggctgtcccttgcattagcagaactggaaaacaaaacaaaagacagtaacaattgaggctttgatgcttgttggaaacatctaacatacagagttagtgtgttgtggtcataaacaaaaggagtttaggctgactccataaattagggaaactgatgcgtcctgttgcttgggacacactacacaattatctgcatgacaggcaggaaagaaagcactggaaggcaaacagactgcagaacaatgtggccacccagttggttttagacacacacacccctggcctgcagaggtgtctatttgacagccggtctcatgtcaaaactttcttttatgtgattttccgattgtaggaaccactgggctctgggtgggtgtcttaggcgagtctgccttagtgttgagtttgacatatggtagcattgttaggtggtgtgtttaggagaagccaaccagggcctcagagccaaaagcatggagctcactggctgtgtgaacttgaccaagctactgaacttttctgagcctagtttgtcatctgcaagtaatgcctacagttcacggcttttgtatgtacttatgagatgttgtacatctagcacctcacatggggcttgtagagagcagttgctcaggcagtgtttgtaagtggagcacaggaagcaagggatggaaagagtatcacatcaggaccaaggatgaaggagtgtttgtaggaaagacctccgagatgatggttgagatggattatgtacaataaacaggaagcatgttcttgggaagtgcttctaagcatagaagggcagcattttcaaaggcatgggtgtggaggaatctttgaaacccagggaactgtagtagagcatggctcagtcccagggtatgagatggggagtttcactcattgagacaggacagatgagccagcgtgggattgagtggggactcgtgtatcctgttcagactatagtcacgatgatggagagtcgttaaaggctgtagacatggccaggcatagtggctcatgcttgtaatctcagcactttgggaggctgaggcgggtgcatcacctgaggtcaggagttcgagaccagcctagccaacatggtgaaaccctatctctactaaaaatacaaaaaaattagccgggcgtggtggcatgtgcctgtaatcccagcactttgggacgctgaggtgggtgcatcacctgaggtcaggagttcgagactagcctggccaacatggtgaaaccccatctctactaaaaatacaaaaaaattagccgggcgtggtggcgggcgcctgtaatctcagctactcaggaggctgaggcaggagaattgcttgaatctgggagctggaggttgcagtgagccaagaccgcaccattgcactccagcctgggcgacaagaaccaaactccatctcaaaaaataaaaaagctgtagacatgagggacagcatttcatttgcattttggaaatgtgacagtaatgtctctcgggtgggtttagagattggggaggaaatgagctctggcccagggtaatgatttcttccatattttccacaaatcttagcacagggctaaacgcatagtagatttttagggaaaacctcttgatggccttgaacaaaagttattgttttgccaggatcatcttttccatgaatcacttgttataccattagtagattattcttgtgtggagttgatcattttagcccccaaattatttttgtccctcgattacatcatcttaaacgattgtgtgttgtggcatagacatatcctaatctacttacaatttatggtgcaagtatctgtgtcataaaagatatcttcttctttaaaatatgctagcctagcactccatgaaaatggagactcacagtgctgccctgtccttcaaagatgtttatgtacaaagggataactgttcccacccctaaatgctttaggctttgcctatactgcctttcaaagctttccctattttaagattttttgaggccccttggatctctggaaggagaaagctataatagcttttggtttctgattgtctttaagcagagaaaactcacagtctcatttaggggcgtgacacattcctagtagggatggtcagtcccaggcaatagctgtggccatgggctgttgagggccatggtgagggcccatgcggtaacagacagtggtatgcatgctggactggggtgagtaaatagccattattcagaaccacggattctattttcaatcagtctgtcaactgatatttttgagagtctgccatgtaccaagcagagtgctaagttctgaagatactaaggtagacaagataaaaatggcccctacccacatggcactacattatagttattataggagagtggatagaacatatctagtcaattaccgtgcactgagaaaggtactgtgagacggaaatacaaagtatggtggaagcatcctggagtgacaactgaccctcacttggaaggccatgcaggacttccatgagggtcaagagtttcctgaacccggacaggagcaagatctaccttagagaggtttggggtgaaataacgccatgaaagggatagtctttaatctagaaggaaaaatggagtattacacatttgtaataagtgttcgagatagcctttgagtcatacagtatttggaatgtatgcttggctgtcagtgatcttataagacccaaaccacagttttctttatgctgtgtcctggcgctgccaatggccagctggaagggccatggcagggtagccacgtagagaggccacctcctagaggcgcatagcctgaacgaaagcggaatttgaacaacacctccgaaaagattggaaagtcatggtatctgtgcgattgcccacaaggaggtctcctgaagtcgaagccctttggttctctggcgttttaatgatttgctattctgtcatcggaaatacgtggagcagccacatccttagacagaagaggcccagccacgttgctctggagtagaatttagtatgagtgtgagtggaagttaaacagatgtggaagcgcagagtgcagctgaacatcattgacatggaccagcaggtaaacagacttcaaggtgatacacccccgtaaggcaatgttctggccagctccgccagtcaaggctgtacagcggatagtaattatttctgtcacagcgaagatagatgctggatgtgggcagatgggggtagacttgtgaaaagtgtgagtatctttgagtatcttttataaatttagtgagtggagtggcaacccacctacacttctaatttttgctgttggaagctatgtccagaaaagagaagagaaatttctctacctgataaattacaccttattcaaaacacactgtgtgaatgaaggtgctgcttcgtcttctctctgctaacgtaacgttgtgcacaatattttttcttttgaagcagcagaaggacattttaatagaaaaatacctttactcctgttaaaggagtatcttggagttcttcacctgtctttatgggggacactccccactacatggcttcataaggatttagggatgacttgctcattagacatagagtgagctggttagaaagacaagtgtgagttggggtacagtggcatagaatgtttaaaatattgagcaatttaggatccttattctggactttaattgtttctagagccagcctctccacgtgtgagtagcatctttgagtggcaagaaaaccattctgggttgtcattgagagcatgtgtccttggagagtgccttagcagtacctcctgtgtcctcccacgacacatatccacctatgcacacgtccaccatcctatacgcacacaggtgcatcttgcagtttcacagcccgagcacagccagagagaaatgactaacatagacttgatttttcgatttaaagacgctcctctttttgctcttcctcttgaatatgacttttcttttccttattttcagtgttttcaagggaaatgtcaaattttcagacccgtaacttctgctagaatcacagaccattagggactgtagagatctaacatgcccagctggaagcgccacagcaggatagctgtgtagagacgtgcagcaggcattcagaaaaacagatctgcatcttggaaagagaggtcagggctcgacttgtggatttcagagtcactcacttagaagcagtagacatagtacacatctaatgaaagcattcccctgctcggaaatcttcagaagtccctcagattttacagaatcaactcaaattactcagcaagacctttgacaccctccaccatgtaacctcttctttcctcctctcccacttctgtctccccacacacatacacctccaaccgcaatggtctcttgaacatattagcacacgtttcttcccactttttctcaagctgttttatttctttagcattagctcagattccacttccttctggaatctttctttcatgaattcagatcgtgaaagaccaaagggaatgttggggcctgtcatgaattagaaaatatattctctgttttcaccaatcacaagtcttgtatgacttgcctagaatagcttcctttatgtgttctaagggatatgggagcccgtctagactggcctccttcacagcgctgggatccgttctgcaaacccatcacagaaatacatgtggcttcttcctgcagtaaaatatgtaggaacttatccaagatttttctttttattcttcatttatgttattttatctccagtgttatgtctccaaggatgttaggttgaattatcccctctgaaaagccatactagtttttgaattaggatgcagtgattctaacttcaggtccactgtcaactcattagtttatttaggcaagttgcataacctctgccttaatttatcatctgtaaaatggggctaggagtaactcatgatttttataaggaaaaataagacctgaagttaaaacattttggaaaatgttttcaaatatggaatacaaacatgaggtgatattattgctaccatattgcttatagtcaagaaaaaaacttaatcctttttgataatctaatacagactgtgtcatactatatgttgcaaaaaatgtatagaacttgacattcgaagagatgagtattttggctctgtggtttattagctgtgtgtccatggctgacttacctaacctttttgagcttcagtttcttttctataaattgggaataattatgttactatttattagggttgttaagtaattatattctgcaactattatgcatgaaaggcacttttaaaactacagaagagcatagtcaacagtaaccatcatggtctcacttatggcctaataattatgcctactgtagaaatagatcaaaatgtatttggattcccttttctaggataccctctcagattgtcccaaatatacaagggatgaaagaagaaggaacaagtgtgggctgaatatgcagaagaggatggaaagttgacaggagcatgtggttggaagaggccatgttgacatgcagattgtgtgatagccacattgccagagctgagagggtgcaggagggaaggcaagagggaagccttggtatccatgtaaaaccagtgaccacttgctagggtgtgtccataagcattgcatgcctattctttttttttttttttttttgtattttatttatttattttactttaagttctggggtacatatgtagaacatgcaggtctgttgcataggtatacatgtgttctggtggtttgctgcacctattaacctgtcatctaggttccctcccctccccaccccagtccccaacagaccccggtgtgtgttgttccccttcctgtgtccatgtgttctcatttttcaactcccacttatgagtgagaatggcatgcctattcctttttttttttttttttttttgagacagagtttcgctcttgttgcccaggctggagtgcaatggtgcgatctcggctcaccacaatctttgctcctgagttcaagttattctactgcctgagcctcctgagtagctgggattacgggcatgcacctccatgccctgctaattttgcatttttagtagagacggggtttcaccatgttggtcaggctggtctcgaactcccagcctcaggtgatccgcccatctctgcctcccaaagtgctgggattacaggcgtaagccgctgcacctggccagcatgcctattcttgaatgtgccctttaagcagtagtggacaacctggggcatcggtggtatcctctgtgggacaacagacacctatatgggagctggttccgcttccctcacttatggctttttacagccatgtgccgcataacgacatttgggtcaacagtgggtcacatatatcatgatagtcccataagattataatgaagctgaagaatttttatcgcctagtaatgttgtagccattgtaatgtcctagtgcaactcattactcatatgtttgctgtgatgctgcaaccctactgtgctgccagtcatgtaagagtagagcacatgcaattcggtacagcacataatgcttgataatggtaataaacaactgttattggtttatgcacttactatactatacttttgatcattgttttagactgtatttcttctacttatttaaaaaaaaaaaagttaactgcaaaccaacttcaggcaggtccttccatagatgtgtaagaagaaggcactgttgtcataggagatgacaggtccatgtgtgttattgccctgaagacctctcagtgggacaagatgtggaggtagaggtgatatgaatgatcctgaccctgtataggcctagactaatgcgtgtttgtttcttagtattttattttgtttgctatttatgtatttatttatttattgagacagccttactttgtcgcccaggctggagtgcagtggtgcaatctctgctcactgcaacctctgcctcctgggttcaagccattctcctgcctcagcctcctgagtagctgggattacaggcatgcaccaccacgccggctaatttttgtatttttagcagagacggagttttactctgttggtcaggctggtctcaaactcctggcctcaagcaatccacccgcctcggcctcccaaagtgctgggattacaggtgtgcaccactgctcctgccttagtattgttttaaaaaaaaaagtttaaaattttttaaaaatgaaaatagaaaaatgtttattgaataaagatataaaagaagaaaatattttcgtacaactttaaagtggatgatgttttaagctaagtattattacaagagtcgaaaagttttaaataatgtgtttataaagtaaaaaagttacagtaagctaagtttaatttattattgaagaaagaaatttcaaaaataaatttggtgcagcctaagtgtatacagtgtttataaagtctgcagtagtgtacagtaatgtcctaggccttcacattcgctcaccacccactcactgactcacccagagcaacttccaatcctgcaagctccattcatgggaagtgccctatacaggtgtaccatattttatcttttctgcttcattttgactgtatcttttctatatttaggtatgtttgaatgcacaaatacttaccattgtaatacatttgcctgcagtattcagtacagtatcatgcagtgtaggtttgtagccgggaagcaatacattgtaccatgtagcctagatgtgtagtaggctgtcccatctaggtttgtgtgagtagactctacgatgttcacacaacagaatcacgtgaagatgcatttctcagagcatagcccaccgctacccaacacatgcctgtaggtgaggatgaggaggtatctgtgttaaactgtgtcccccaccaaaatgttgacaggctaaacctcccagtgtccatgaacaatggctttatttggaaggagattttgcatatgaccaagttcagatgaggttattagagtgggctctaatctgatatgactcatctccttgtaaaaaggggaaacttgggctcagagatagcctccctctgaggctattaccgtgtaaagactggagttatgctgcccaaagccaagaaacaccaaagatatccggaaagccaccagaagctgggagaggggcatggaacagattctcctttgcacctcctggaaggaaccagccctgcagacaccttgatctcggatttctagcctccaggactgtaagacaatgcatttctattgttgaagccccccagtctgtggtactgtgttattgcaaccccaggaaactaacacaggcaggtagaccatccacacacaccaccgcttctctctgacgcctggtgcacagcttgggtcttgtggtgagactccacatggtaggcatttgctggcggtggatgttaaaaatgacaagatttcctctggtttgacttttgaaagcaggtgcattgaaagccaaatctcagggtttggggttggtttagaatgggatttctgaaacattctaattgtctcattgccatcacctccccaaatactgtatctttatgtgcatttggaaggaaaaggagtgcaattgaacagtatatttccgtctgttaggcaaaaccttttatttgcttcttatttttccaggcttggacactttcgtgagaatatttgcagttctgttgtaagtccacttcggtcagggatttggcaagtccacaacaaagagagggaatgtttcttttcccttttcccactttccttgggcttgcctgttctttctctgaaagatgctagaacttccccaaggggagggcctgcctttttcctccttgggaaatgttgatttatattatatgaaacatttgtttttcatagaaacttccatttcagcatgttgaaatagttggttctaatttttatgtgaaaaataaataaacttgtcgtggcaatactctcagggtacagttacataataactatgtatgcctccccaccactcattaacataggagatctcacctcacggaagtcatctcatagtctaagctttatggcttctaacagcttttacgaaactccatgaaaataccttaaacataactgttacaagttgaaagtcaaccctttttataagtatgtcagaagtaattatatcttgtagtagcaatttcatatctctacttatagttgggacaattaaggctcagaaaaatggcaaagctgagattaaaattcaggattttctgatttctagccaatgtcatgctcattttctgtgttaattttatggctcagggtccagttaaaaacgtctgaagggagtggtaagtacaagagagatgggagttgggggtggggcttgaaggagagcacacctggccccaggtgacaagactgggctccagccctgcctcatcacagttggacatgatggccctgggtcatttgacttttgaggacctcaggaaaatgagggagcttaaaaaattctatggttcctaatgaaatacttagggatgaaattacagttctgggatttgcttgaagacacaatcagccatggtttgtcactgttgatgctgagtaatggatatttggtgttctattgtgagtctttggtacatgtttggaattttccatgaaaaaaccttctgcttctaaaatgcacaccttgattcttcccatcgccctcctactggctggtcctgtgcagctcactcatttctcaggaacagcagcagactcactactctgaaggaaagaaagccctttgctttggtctgttcctaatgtacatattattagagacttttccgacaccctccccattttttatttcttaacagctaatacgatagctgtgctttcataataaattcaaaagctgctctctatttctcaccagtttgaattgtagaaaagagtacaaaagattagagtactttaaaataaatctcagctaattatacatacaactgcattcactaaatgtgaatattttcaggctttctttgctaccaagtgccacctgctcatgatttaaatgggcacaaatttagttccattaaacaaaatgcagcaactcttctcctatagcgcaaactcctttaggtcctattttgaaactgagaagctaattccagtgttctcttgttagctctcggtccatgtcaaccaccccacaaggttgtttacttgaatagtttgcagccttgctttaaaagttctagtaggcaaataggtttgttgatgatgaagtggtttgtgttttataagagtccttatggtctagatggcatttgaacttgtggttccagtgattaccaggaccctgaattgaagaatacatgctgtggccttttcagctcaggaaactttttactttctattgccaaaaaaaaaaaagacaagaaatccttcctcaaaatgttatgtgttcttagcccatacaactgtctccccagaagtcactggactcaaacctccactttgctacttgaacatattaaggtcatttaaggagaattcattcatctcctattaatctggaacattcatgatcgctgtaagaccaaagaggacattttggggggtaataagaaagttaaagctgccttcaaatcaaacgtgaattatgaaactcttttccaagaagcttctattagtggcctcatcagctatgtttcaagaaaggaagttgaaaaaaaatcccacaacatggaatgcgtatttgccatgctcttagaaaaatggtttccttgcgaagactcctttgtctctacatacctggacctgaagaccttggtgttgttttataaccctggaagcctggctgtgatcatctattaaggaaggagaaggaagctgcttatctgtcctgaaagtcttatttctactcatcttctcgcctccttccacaccacctccccacctacacacacccttgccctaaattcctttccattttgtcctttcgaaaactcctccctcccttagaaaagctaaaaataatggtaatactttccagtgatcctcccttattaggatctcagatgcaagctgcaggcaaggaggaaagcctgcatggtcgctgctgctcacatctgcatggttacaaatcgtggctcactccagctctcatcttagatgttcatcctcacttgaatcccagtgccataacacgccaacgcgcctggaaaacacctgctgtctataggttgcaagcaccccacagcatcccagatgtagggtcatagactcagagaattgaatacacacccaaatcctctagctgtcattagggggagtttcacatgattgtagctacacccaggattttaagcccccaaaagttatttaggaaggattgcaggctcattcttgtgttcttaggagggtcccgacctgcggataaagacctagaggaagggggaggccttgaggcggagtcccccaagcagagccccaacttgtgtgtgatcctgcgccacaacttggccagccggcctggacagctggctctggttactgtgggaacaatgcaaggaaggccgttgtcacattcctctgaggtcaaaggcacaaccttcgtcacacactcagtccctgctggcaaagagaaagacgaggagcgtggaatcggagacctggagcatgcgagggacttgagaaattcaccaactcccttgttttactgattaggaaactgaggtgcagaggagagctatgacttgctcaggatggcacacccaggactggaattttctcttcatggtccaataccctgatgttcctctcatcatctccagtacttcagacttgatagtaaaaaaggattcttgataacattattatattttgttatgttttcccatgctgcaatcgagtctttaggttcgaagtgacaaccctgttacttttgttgcgagacccttgagtactcccaggacaaatctagccaacaaatagcatctttagtgaccctatgggaagtcattggcttctagccctaaacccagaggttagagttaatttttaagtgctcgcctttaactcaagcatgaagctctaaaagcatcaagtagtaatgcttgaaaacatctaaattcctctgagccctaggcatgcttaaactctctctctctctttttttttttttttttttttaggaaaatagctgaaatggtagtggttagaacacatgcaaacagaattactgaataaaattggtcacgtatcccctggtttaaggcatatttaggagttcaattcacatgtaattgatcattcttttttctcttggcatactttcctgtaagagtcttatgtgccctgcctttagcatatgtgcaagccgataaaggatgttcatttaaaatttttactattttaaaaatacacacagagggggaaaagacttgtcttatccccaaatgaaaagaattagaaataatacttttgcctgtaaacttctatcagttttcctgtcatgggaaagggaaccataaattactttttataaggaaagtggtggtgctagggccacatgtcccctcccgcacagaatgagaggtggtggtggctgcgggacggtgggaaggaatgagcgggacccaggccagagctcagctccctgggctttgcttgtctcgcattttgtaaactcaaatgtcccatcattcccaaaggccatttgtggacatgctgtgattttatgcatcaccttctggaaagaatgtgttccgttccctgtgaacttatccaggttgatacagtagttccccccaccccccatcttcggtgtcattttctgctgtttcaattacccacagtcaagcgtggtacaaaaacaggtgagtgccatgcaataagatattttgagagagagagagagacaccacattcacataacttttagtacagtataatgttatgattgttctattttattattagtttttgttgttaatctcttactgtgacttatttataaattaaactctatcatgggtgtatatgtataggaaaaaacatagtagatatacataaaggtactattcatggttttaggcgtccactggggtcttggaacagatcctccatggatgggaggacaactgtcttttgaatgtgtcagacacaattgtggcatttcttagtgtctttttcctactcgttagttgtatttggctgctgcaaacaccttgggctcccaagtagttgggaatgtggaaagctacatactttccctctagagagagccccagtgtgaaaaactaagatagccgtgtgtttgctgatccttgggacgagccagggaagggctccgggagcactgtgtgaattaaggctgtcaagaccaaagtaacataggagggagaagatgaaaatgcagcagcacgtctcttaatgtgatcgtttctctttccccttactgaagcatagtgctctctgctatttgaagagcgcaatttagatttatattaaggaatgaataaataggatgcggtgatgaaatctcatctggagtgaatgcagattgtggatgctaatgaccgtgtggctgtgcagagaacccattggaagcctgggcgcttctccctcctctgttcacccactaggcactcaagagcaactcaggcagtggggaaaaggttatctttttttaatgtctctcagtgttgcatcttgccttatagcgccttaaagcacttgacaagccttcaagtaattcttggtggtggcgttttcccccagaaggccttaagagatggttttaatagatacacctatcaatttattcccaacttgagcattttgctgtcttgcatcatttgacatcaccagaaagtcctttggttacttctgtagttcacattgtactttctgtcctttgagttttgggtgctcaggggcaagatgtcagaaatcctgagttttagttgtgccactgcgtagctttgaccaagtcactttacgttagcaggatacaatttccgtgttcattaaatgaggagactggactgaaagctcttagaggcctcctctagctcagacgttctgtaacactcagggctttctgcctcctctgatttggcggtgtcaggatacaggtccaagtgcggcactgtgccttgcaaaattgctctctctccctggccagcttttccaccactgtggaatgaagtctgccgcctggaagaatcccagatttctcaaaggcgtccagttctagggagcagcgtgcaaagcccttgagcacactttgacttcttctgccctggctggtgatgaaaaaccaggtcaccagaggttgccctgtttccagtgatcagccctcgggactgaaaaaggaacaaatacagaagagctccaaagaaagaaacagaaagagacgctcaagctgggaagctaagaacaggtccctctgctggggtggaaggagaaagaatcttaatcctctgccttcccccatgggtcagagtcgtaaatgggtgagacttgaaggtgtggttggtcaccctctctcaaagtttcagggctgggtcaggtgtcctagtagtgttgcgtggtgcagtagtgagtccccagcctgcattctgcaaagccccagaggctccccataaactttgaggctgtgggctgccctcagcctctattgaccggggcagcggggcagcttctccttcagctctgtgatattctgaggctatgtaaaatagttttcttagaaaggtcctgtggttaaaaaaaattttttttaaaccactggtttagttacgatgagctcatattcaaagcaatatgaccttagacaagtcatttgattttcccaaacctcattttccttatttcaaaacaagtttagtcatatattctcagcctgtctcccacagcaatttaaggattaattagagtcagttattcataccttcactctatgaacacggtattgaacacctttcagtagaaggctctgttgggagaggaactcataagtaaatacatgagacagccattccaagcagagggaaaaagcatgtgcaaatattttgtaaactgtaaaacacaacacaaacctaacattatgtaatattgctgttcttaaccaggcagtttaatatagtgactctagagcctaactccttggctttgaatcccaactgcagccatttatcagtgtgacttcaggcactttacctaccctcttgtgcctcagtactccaatctgtacaatgggaataataatagaactcatctcactgggctgttgggagagctgaatcagttccgggcgcagtggctcatgcctgtaatcccagcactctgggaggctgaggtgggtggatcacctgaggtcaggagttcgagaccatcctggccaacatggtgaaacccgtctctactaaaaatataaaaaattagccaggcgtggtggcacgcgcctgtagtcccagctacttgggaggctgaggcaggggaatcacttgaacccaggaggcggaggttgcattgagccgagatcatgctactgcactccagcctggtgacagaacaagattccgtctccaaaaataattataataataattaagagactgacacagagtaagcactctataatgtttattattggtgatttcaccaatgcactgtgaaattctgtttcttgattctcagcattgcagtcccctgtcattgcacttccagttttctcttccccagaagatgcatcccgtgttcgagcggaaaggcaagggaaacatcatgtcaagaaaagagttccgaacagtactctgtttctgtggcatggatcctctttcctctccttttctcctttttttgaggttggattggcactcctctcagacttaaacaaaggctttgctttgcagagaggatctttctgccttcggtgtgtcatctgcctctaagggtgtaatttgtttctgatgcatgcagggtgcccccttgagaaggctttgttgatgttgtgcagaggtgtcctgtattgatcggtgatagaactgttctatagtgggtgaatgaggtaattgtcatcaggttactctagtcggtgaccttgaggctgatccgatgactaagccacagaggtggatccctggttatagaatgtccttgtttaaaggtaaatcggtgtgagagtgactaatagttttaaagaaatgatggcaagcaaatggcatgccctttggtgagagacacagtctatatcaataagctctgaggccacccatatctgggtgagatattggggctgattttcaagggttcctttatctctctgctcctctcttatctcttttcattagattccaattctccataacttccatgaccgtgtataatacagtcactgccatgactgtgtataatatcgtcagtgtgaagttcagagcaaaatacataggcctctgagctagttggctgggtttcttttttcttttttaaaaaattcagcagtggggtgggacagagctgaagatgaaaagatgcttgatacaagagaagagagaaagcaagcgtcatgataaaatctgcatgcaaaaaaacccttgttataaaatgaaaagtggaatgaatcattagctatacatttaagctggatcaacacattagccctgtgattaagagtttctaaaacctacctgccagcatccctgctgttgctgaactggtcctttctgcatgggaatgggtagaagtctaaatgaacagacttagagtgggttggcaggtgaaggatagtgggggtaagtagtgaggagaggataggttagaatagttattttgggctgggcgcagtgactcatgcctgtaatcccagcactttgggaggccgaggcaggtggatcacctgaggtcaggagttcgagaccatcctggacaacatggtgaaaccctgtctctactgaaaaaacaagaattagccaggtgtggtggctcatgcctgtagtcccagctacttgggaggctgaggcgagaggattgcttgaacctgggaggcgtaggttgcagtgagccgagatagtgccattgcactccatcctgggtgacagagcgagactatctcaatcgcaaggacaaaaaaccaaacaccccatgttctcactcataggtgggaattgaacaatgagaacacatggacacaggaaggggaacatcacacaccggggcctgttgtggggtggggggaggggggaaggatagcattaggagatatacctaatgttaaatgacaagttaatgggtgcagcacgccaacctggcacatctatacatatgtaacaaacctgcatgttgtgcacatgtaccctaaaacttaaagtataattaaaaacaaaaaaaagattaaaaaaataaaaagaacaattattttggaatcattgaataacagtcagctctttgtatgttggtcaataaaagcaaacacctataatactgctctaagtgctttgtgctatattaaccctttaatcctcacaacttttgttatgtaaattttatatctgaaaacagtgaggttaagtgatttgcccaaggtcatttaaacccagatattggctctgccccggtgcccttaacacttatagcctctcactgtcctgggtggtgaaggtcttgagggcaaagagagaaaggaaattcctattttcagtggacatatttcttgtgccggtggaaggaatttaattattacaaggggtttcatcaagtgcactaatctgggaagttgccagcaagctgacctgggtttaagtgattctcctgctttgacctcccaagtagctgagattacaggcatctgccaccatgcctggctaatttttgtatttttagtagagatggggtatcaccatgatggccaggctggtctcaaactcctgacctcaggtgatccgcccaccttggcctcccaaagtgctggtattacaggtgtgagccaccgcacctggccaagacaccttttttagcttccaaatcgaagtctgtttttgcctgtatcatggttgtatttcagttagaacatcatttctttttttttttctttttttctttttttcttttttttgagacagagtttcactcttgttgcccagactggagtgcagtggtgcagtctcggctcactgcaacctctacctcctgggttcaagcgattctcctgccccagcctgccgactagcagggattacaggcacctgccaccacgtccagctaattttgcgtctttttagtagtgacagtgtttcactgtgctgaccaagcccatcttgaactcttgacctcaggtgatccatctgccccagcctcccaaagtgctgggattacatgcgtgagccaccgcgcccggccagaacatcccaatacataggcagccacttatgcactagagtccttctcggagggtgagcagagttggctctccctgtcggtggcatcacgttggcagaatacacacacttttatcctgtggcggttggcgaggccattgatttgctgcgtagaatagcaaggaaatactctagacaggtttaacatttgttattgctaatgaatttgtcaagcatcggaattcagggacggttgatgcacacttaaaatgctctgaaatagattttaccttttataaaagataataataatctcatgtttgaatcacaagaggtacgttttccttaaatcttttaattaactcctatttcaagaaaaacctcttatcaaaaaaaaaaaaaagattttacatttcctaaggccaagtaagagttgaaggtagaatgagtaaataaccaagtttatggaaattgtaaaataaatacatgtgttataaatgtgctatttaatgaaaatgtgtattgactagagcaataatgatgtatctttgaccatgataagtaccagtgctgaaatccatccaagccacaaaaatgattggagggtccatgtggaatataaagctctgcagagtctagagctcatatcctatatggctttttgctaattaataaacattggccttttgtctattatttaatagcctaattgcattgcacattgcagtagcacattgcaatagcacattggcaaaagtgctgcctttcactgctaaggggggcagttttctgtaaaagaggttaaaaggagaaatcagaagcctaatttttgttaaatgagatgtcccccaaaagtcagatacatgcatatttgggctaaataaatctttcctgggaaactcttctatgactgggcagagttgttcacgagagactttccccccaacattttattaggaaaaattgcaaacatacaagtaaattgtaagaattgtacagtgaacacccataaacttgccacctagattttgcaaataatattttgctatatttgctttgtcaggtatcaagccatctgtccatcctgcagtccatcatgttttagttgatgcccttcaagactagttattgtgtatcattactcaatcaaaataaaatattggctttagttcttgcttttaggtaaattttattttattttattattactattattattattattgttgagacagggtctcactctgtcgcccaggttggagtgcagtggtacgatctcagctcactgcagactggaccttcggggcttaagcaatcctcccatcttagccccctgagtagctgggactacaggcataggctaccacatccagctaatttggtttttggtttttggtttttttttggtagagtcagggttttgccaggctggtgtcaaacttctgggctcaagtgatccaccctctttggccccacaaagtgctgggattacaggcgtgagccaaccatgcctggccagaaaaacccaaattgagggacagtccacaaaatgattagtctgtactccttaaaattggcagattgtcacttttatcacatcatatgtgacctatcatgggctgttgatcttgatgacctcagccgaggttgtgtcagggtttgtcaactttaaagttactctttgtacacagacacactcacacacacccttttccatactgtactactcgttggaaggaagtcactgtgcacagcccacacttaaggggtgggcagttacgctctacctttacaagggcagaacatctgcatgaattatttagaactcctttgctcaagagatgcgtgttttcttcctcttttaaaatttatttatatcaatatgaactcatgggtgtttattttattctttaggttctaatccagtactatgttgtttattttgttgctctggttgttttagttctggccattggcagctctttgagaaatattaggaatattgtctcttgtcccccttttatatgcccccatcactgtggggtattgatttatctatttagcattttcccactttctgatactacaagatgctccatgctcatcttggatattccctgtcacagtactagaatcagccatttctccaaagacccctggtttgttttattggagaatggtgttaggaactaagttctgggtgctggggcttgcagaaattttatgcccaacacatattagctccccctcttccttttgtgggagtttggtgtgtgcagtagtgagtgccctgtgaaatcttcatgctacagattgactttagtccctcactgatcctagttcacttcaggaggagcctagctcactgtggcagactagacagaaggcagcccagccagtcaactcaacagatttcatttattcagctcaatccaagtcagacttggtgctgtgcttattcctgtgggcagatgccctgccctcacagacccctgccctctagaatcaaatgacaggacagtaacagagaagtgctgtagaaaatcagaatacagaagggctggtgcgacctagcctaagagcattcaaagaaagctgtttatacaagagcagacttaggaaggtttattccagatgaggaggctagaagcaaagacatggaagtgggaacagatagtctcttaaatatctatggataagaagaaagccgaaaataatgaaggactttgcttcttgggtttattttaggtaggaagtagggtttactgatcttggtgggatgaggaaatggaccagtggtgtagtggagccagcttgcacttttatgagccaagtgttaaatgttcagaaatttggggagcatgttgacatcatgttattaccttgaaattggccatggtgggagtgtttacactacagaagtctgcaaatgctacacatcaggggtcctctctcccctcccacttttattaaacatttctgcacacaccactggcttcagctgtctaaatatctagtatgtacccttaccctgaatttatttttttttcctctagtagtctttttcaggtacacatttttatttggtgctttgaattctctaacaaaactgtcaaaaaatggttacagtagagatgtgtgcccctgattgaaaactgcattttactgcatattggttaaaactcttaacggtcagaaaattttttggttaactgggttatttgggaccctctaatggccattctcaataactgagttggaaaagtgcatgattcaaatgtactaaaccattacccagccttctactttattttggcagcatggggaaacctgttgtcacctgaaggtagtcatcagtgtcatatatatgtggtcataggatttatggttgggctggcttggaggtatcttctgattcttaccaagaatataggaaaaaacgatatcattttctttcagctgagaaaccatgactcaacgttattctgcttgtagtaggcaatgcaaccctgtatcagtttgacttttgcaaggatgatacctgagtaatccagggaatagtgctatgcaaatagggacagtttccatgaagtcacctcttgtgcatggtatatggtgttaagtgttatgccgaattagactcagagcagcttacatttcaaacgagtcacctaaaagcagttatatgcgtgacgaaggagaatggttagggaaagaagaagacttctcttactcataactggagattgtgagttttcactgtgatcctgaaagataggttggctttgccttaattacagggatttcttttacctctttgccctttcctatgtccctccatcaggtatggtaaattttcctagcttttgttcctattagtgactttactcctgatccactgccaaattgggtctctgaggttgtaaaactcagaaaaggatattgcaagcattctggccatattacaaatctcatgtgagagctcactctgaatcaaaggagctctcacattcttttttagtccaagtgattcctagatgtggaagccgatttcctggaacactcaaacgaggtcacagttcatcagctgcctcccataaaccaaccctctcaagtttcaactctcatttgaaacttcttgggatatcttgatccaaacagatcacctgaaaagctcccttataaggtcaagtgatcacaggggtcttcttcttcttcttctttttattgtgataaaattcatcatttttcccatttttaagtgtacagttcagtggcattaagtacattcacattatattgcagtcatcaccacgatccatcttcagaacgttttcatcttcccaaagcaaaactgcatatccatgttgtagcatgtgtcagaatctccttcctctttagggctgaataatattgcacatatgtatcacattttgtatctattcatccattgatggacacttaggttgcttccactttaggttattgtgaattatgtggctatgaacactggtatacaaatatctgttcaagtgcctcctttcagtttttttgggtatatacctagaagtggaattggtgaatcatgtagtattttttaaattttttgaggaaccatcatggtatttttcacagcagctgtaccattttgcatttctatcagtaatgtacacagagttccaatttgtccacatccttgccaacatttgttattttcttgttttgggggttgttttttttgttgttaatcagagccatcttaatgtgagtgaaatggtatgtcattgtggttttgatttgcattttcctaatgattagtgatgttgagtgtcttttcgtgtgcttaatggtcatttgcatattttctttgaagaaatgtcaattcaagtcctttgcccattttttaatcaaggtatttgttttttgttgttgctcaagagtcttcttgcatgcctagatagtacactacttcaagaggctatttagcatttatctggggttccatggggcagcctgttccctttgcacatatgtaatgcagagatgaatatgtagagacttaccactggaaaactgcacctggaattctcagatttgcccatatctgcttatcatggacgaggttcagtggtggatgctgcagaatataccaccgactgcttttggctactgtgtgacattgtcatctaacttttcactaagaaaaataatctctttagaggaaaggaaggaagttgagagtccatcttataatttttcagtgtaataatattctagaccaggtattgacaaactggaccatgggccaaatatcaccccagcctgtttctgtaaattaagttttattggaacaccgacatgcctgtttgtatgagtatcttcaattgctgcttttgcacgacaatgacagattgagtagttgcaatggagatgtctggcccacacagcctaaagcatttgctccctggtcctttatagaaaaagtttgccaacctttggctgttctaggtgtttaagaaatactatttttagaaccgtatatataatgtagtgatgttgactgcaagctattcactttgaaaacaataaagcttatgtagtagatattactgttttaagtatttactgaataagatagacccctgttacattactgcttttaagtatttactgaattccaattttgtgtccagagctgtgttctttgcctttgttttttgattggggcaatggctttcatgtccttagcaccactggggctgttaccagatgtgaccaaaaggtttctaacatgggtagcactttttttttttttttttttgagacacagtttcgctcttgtttcccaggctggagtgcaatggcatgatctcggctcactgcaacctccacatcccaggttcaagcaattctcctgcctcagcctcctgagtagctgagattacaggtgtctgccaccacgcccagctcatttttgtatatttagtagagacagggtttcgccatgttggccaggctggtcttgaacttctgacctcaggtgatccactggcctcggcctcccaaagtgttaggattacaggtgtgagccactgcgtcctgcctgggttgcactttttaaagtcacagaatctgaattctgcctttcctctgtgatatttcctattcgtactaaactttggtgaagtagctctgatctttagctgtggtgagaggagttatggaagagggacctgccccgaaacgtagaccacaggcaacttgctgcctggcaccctaaagatggtttcctgcttctcttcccctctatctccaggtcagagatgcagctttgctaaggcagtgattgccaatttgggaattttgagatactgtggatgtgctgattgttttgtacaaattctcttcaataccttgaccatgtatacagtaaacttatgctagctgttagaggacttattaaggtgtatggacactgtctttgaagagtttatatggtatgttttggcagttgaagagtattaagcattgacttaaaaaattatgtataataagcattgagataatgggaaagaaatgctacacatacacacacacgcatacccacccgtgaacacagacacccaggaaatcataaaacctgattgacttctatgtgtggatgttttctttttttattcatttaacttatattttaagttcagatgtacgtgtgcaggttcgttatataggtaaacttgtgtcatgggggtttgttttacagattattttgtcaccaggtactaagcctagtaaccattagttatttttcccgatcttctttgtcctcccacctccaccctccagtagattccagtgtagatgttctcttaagtaaaacgatggggtagtcgttttgtacagtccaaataagattccgacaatggatgaatctgctaagaggttaccttttgctccagatacaatatttatctaaaaggaaaatgaacccttaacccttccatggaatcgtactgcttcactaactttttgagtgaagtgatgggcattgatacagtattgaaaactttcaggcccttttctttactttttgacaatttgaccttttttcacccctgaaatatagcaatcagtatttctcttctggatctggttctacaacctacgttgattttaattactttccttgaaaaccattctcaaaatactctctgccccttacattttaagctttaatgttgaaaatagagctttggtaagagtctccttgaaaatgattttcttcagccaatatcagaggagtatttccttatttttatatttatatgttttaattccttaagaacagatatctaccaaatttcatggtatagatttataatcatcttttcaattttagacaaattttggaattcagatgttgctctttgaaatgctggtgacttctccaacttggggacattcacggactcaataagcatgccttttatttatgattctctgaggattcattcatttctgcatattttgaatgtctgctacacagagataaatgatgtaaaatccaggctatcagagctgggtcacaatttagtggagaagatgagtacgacaaaaatttaccatggagtgtgaaaagtgctcctcatagagacatgtacatcatgccatagtaagtttagggaatttggaaactcacttaagtcctaactcaatttaaattgtgttagactgtggataaatttatccgacgagaaacacataataatatgtatctactctgaggtaataaatgaaaaaagttggataaaataaaatacatctgttataaccaatggcccccagcaaggccagtgctcttgagccattattattcctgcacattctttgtgtttgggttattaacattgcgcttaggtcagatgagcgggtgttcaatctgccacactttgataactaaagtaaaatgctgatggagatcatttaagactgtctctatgctgttgattgcatgcttgtggctcataatcagaatgatgcaaagtaattgttagactgacttgccaaggctacattttgtgtcgttgccactgtcagcactttggtcccgctgtgctgcctgaagaacgcttgcctggcacctgttgggcactaatacacaactttccactgaatgtcatgggtaacttttgttctcatatcctcgcttgctatcttcacaaaaaaaaaaaaaaaacaaaaaaccctgacaaagatttttttttttttgacagagtcttgatgtgttgtccaggctggagtgcagtggcacagtctcagcttactgcaacctccacctcccaggtttaagcaattctcctgcctcagcctcccaagtagctgggattacaggcacacaccgccatgcccagctaatttctgtatttttagtagagatggggtttcaccatgttgcccaggctggtctcgaactcctgacctcaggtgatccacctccctcggcttcccaaagtgctgagattacaggtgtgagccactgtgcccggctgcaagtgcttattttttgtttgtcagaatgcttatgtattgagactttaatctctcgtgcatgttgccagggagctcatcttttctctttgaccgtgaaacccagacaaacctagctttgtcacttactggtgaccttggttaggttacttttcttgagccttattttcctcatctgtacaatgaggccaataaaacctattttacagagattttgtcaggattaaagataatagataaaaatgtgtccatacaaattagccactcagcaaatggttgtggcaaatattaaggaatttaatacttactcaggatgatacaatacaacgacaagacaacatttccaaaagttagtccgaaaatataatgataacgtaactgtggaacatgtagtatcagcacggttttactgggcaagtcatgtttaccagagacacacaattggatttggatgttaaaatctaaaccgcatggttttatggctagatctggaatacatgatatgttatgggccctcccatgtataccttcagaggatatggagctacctttggaagcaatgtatgatttagtgtttttctttttttttttttttttgagagggagtctcactctgttgcccaggttggagtgcagtggtgcgatctcagctatctgcaacctccacctcccgggttaaagagattctgctgcctcagcctcccgagtagctgggattacaggcgtgcaccaggacacctggctaatttttgtatttttagtagagacggggttttgccatgttgcccaggcttgtcttgaactcctgacctcaagtgatcttcctgccttggcctccgaaagtgctgggattacaggcatgagccacagcacccagcagatttagtcttgatggtgtaaaaaagccattgtatagcacacaacacagcctgaccatctaatgctcactcatgtaaaagcggtgaccacgagagagttgggcaaagcaaaaactctgtccctataagaagtgcattgttagatctggaaacatctcaccaggtcctgaattgtactatgaaaagagatttgttaaaagtagctcagttcatattccatgatattgcaaatgcctagagtgaattgtcaaagaaatgctctctctgactccatccactgctgacatttaaggtctgtgttcttagttcccaacattgattctatttcacatggtcaaaatgtaatagacatgttttttctaagagcatgacccccaccacaaattaccactccccttaaaaattgcatcggctggaccagggatgaagcatttagggagcatttgttgtaagggactgtcacctgccattggttatggaccttggtttcacagatcagactctgtgttgctctactttgcatctccgcctttgatctcgctgggattttgcagccagtatctatctcctttggcatttctttgctgctgctatgtgttctttctccctctgctgctctctgccagccccatctcctgcctgattcatggagcagtgttggatacttagaaaaggttaactgcattcgtgtctccatggctggagacacgatttccacacactctgcccattgcggggatatgctcacttccccagcctcccctcaaaagtgagattttcctggaatgtcactagtcgcggggggaggtatggcacccttaattgagggcaaggatgtgtcatgtgacttcagcaaatcctatcacatatatttttaccaaaccaaccattctctttgagaaggaacttagattagaaatattaacactgaatgaatattttaatttttgataccttctaaagaaatatggtaagtcctgattttttttttttttttttaggttttcaccttcaaatagtgatttaatttctaggatcactcaagatcatacagttttttcagttaactttcctctgtatcattaagtaactctaccatgattgggctgaaacaaggacatttgcttgacttcagacttagcgatttaatacttgatctagccatccctattcacccattatcccgagtctttaaaattgagtcctttttcgatatgttgaacacccactgaatattcttttttttttttttttgagatgaagttttgctcttgttgcccaggctggagtgcagtggtgcattctcgactcactgcagcttccacctcccgggttcaagtgatcctcctgcctcagcctcccgagtagctgggattacaggcacctgccaccaagcccagctaatttttgtatttttagtagagacagggtttcaccattttggccaggctggtcttgacctcctgacctcaggtaatccacccgccttggcctcccaaagtgctgggattacaggcgtgagccaccgcgtccggccacctactgaatattctaatgtgtgattctattccctgtggtatatgtgttagtttgtgttcttctatgctacacccactcaaaccaaaacaactttttgctgttaaggctttttatatttattcagcctgcctttctcaatcttgaaaaatgtagaagaaaaagaaccacatgctaccacaatatgtagtcacttcttataaacttgggacactttggtagactctgtaaattcaacaaataaatatgtattggttcattccttcaatgtaatactctttcagtcctcaaatgttatgatgttgatacatctattgatgttaaaggaggttttcaatataattaataagtaaaaaaaatgagacagcaaaatactatgaatactatcatagtacattataaatagattgtatgtatgtatatatatatatatatatatatagatttatttctatatgtatgtgtacaatatactctgtatacttgggcataggagagagtctggggtcatataaccagactgttaatagtgattattagtgggacttctgtggatttgtattacttgggtttttctatttatctaattattatacagtgaacagttttattttgttctcatttgtctcatccactttttttgactgcatagtcctgtaatttttttttaatttttaatttttttgtgggtacataggtgtgtatatgtatggggtacatgagatgttttgatacagacatgtaaaataaacacatcatgaagaatggggtatccatccactcaagcatttatccattacaacaaacactccagttatactctttattttaaaatgtacagttattattgactatagtcactctgttgtgctatcaaatagtagatcttatttattctaactactttttttgtacccattaaccatccccacctcccctccagccccctactacccttcccagcctttggtagccatcctcctactctctgtgtccatgagttcagtaggtttgatttttgaatcccacagataagtgagaacatgctaagtttgtctttctgtgcctggcttttttcacttaacataatgatctctcgttccatccatgttgttgcaaatgactggatctcattcttttttatggctgaataatattccattgtgtgtatatactatactttctttatccattcatctgttggtagacatttagattgcttccaaatcttagctattgtaaacagtgctgtaacaaacagaggaagtgcagatttttcctcaatatactgatttcctttcttttgagtatatacccagtcgtgggatttctggatcatatggcaacttgtctcatttacttgtgaggggtgaggaaaaagggaatacagtacaggtactcacattctggtaatttttgttgttgttgttgttgtttttgttttgctcttgttgcccaggctggagtacagtggcatgatcttggctcactgcaacttctgcctcccgagttcaagcaattttcctgcctcagcttcccaaatagctgggattacaggtgcatgccaccatgcccggctaattttgtatttttagtagagatggggttttaccatggtggccaggctggtcttgaactcctgacttcaggtgatccacctggcttggcctcccaaagtgctgggattataggagtgagccaccacgcccagtcacattctggcaaattattaagtcaccaaagtctctcctgtgtctttcctccattgttacagatatatgaacatgttgtgtgccaaatggtgataatgcctttttgttttattcagtctcttctgtgtaccaagcgccacactaaaaactagaaacattctatgaagtcgatattgttattgccattatacaaatgaggaaagggttcagagagtttaagtaactggaaccacacagctcctctgtgactcagctgaggctcagactgaggtctgactttgaaatcagttttcgtggtctcaagaattcgtactgtagacgtctcgtctgttgttaggatgaaaaggtcaatgcgtgtgagtggattataaagtgttgctttaaaacgaagaagatactcagagattttgccagtatctaccatttttcaatgtttgcatggctttctggcagtttttttcaattggagcataacctttgtctttgcagccccacctagcctaggatagtctgactgcatagtaagtgtcatgttaaacacttgtgggctgctctgtgggacttggaggagtgcccttcagattctgaggaactgagtctgggaatcttcctgcaggctggtgggccatcctgaaaaagctctatcctgccctggtggccggccacatgccgtccacgtcctctgatgaaaagggcgggaaagctgtggccttccacagctcatagaatgaatcccaaagatgctggaatcctgggaaacttgcccacagaacatcaggagctggaatagctttgcctcacagcctctcttaaacctgcaaaggcgtctttaaaatagtctctggagattattgttgagttggatcttgaacttagttccttgtgtggtgtagattaaatagtctgttgccgtcgctcccttatctccctttctttcaggcttcctctgtccaacattcacatcatctctgttctttcccacactttgtttggcccgtcagtatctcagacactgtggcttcctcacgggattactcagtcagcctgatatgtggcctccagcgcccctctgccaagtccacattcccatatgagcctaattacatacagatcactgcagggagtgaagctgtgggtataccattttgggaaagagcaaagtgcaggaatggggtactttggttatttattaagacttcttcacagcctggcaatgtagcaaaactccatctccgcaaataaagaaaaaacacaacattttaatccaggtgtggtggcacatgcctgtagtcccagctacttggcggctaaggcaggagtttgagtctaggagttggaggctgcagtgagctatgatggcatccccatccacggtcactgaattcccccatgagagggactttggagggaggatcccagggtctgagctcagctctgccactcacagccatgtgcacgtgagcaagtggctcagtcccctgggcctcagggtttccagctataaaatgggcacggatctatgacaaacccgggtaacaaagcaagaccctatctcaaaaaaataaaacacggctgggtacgatggctcaaacctgtaatcccaacactttgggaggctgaggtggaaggagcgcttgaggccaggagttcaagaccagcctgggcaacatagtgagaccccatctctacagaaacattacttcaaaaaaatacaaaaaaagacttcttcaataagcatcatggtgggcatggaggacatgacattttaagaaaggcacctaaaaaattgatttcttgggcaccacaatatggactccttgtcacaaggaccatacatctcatgataaatgaatcatgcctgtgattgttctctacatattgattgttcaaagctctgcttttaaaattcatatagtcagccaaataatcacgcatctattgttcttcagacatttattgtgcacctaataaaggccaaagtgctaggggctggaatttcttatcacctctaggcctgctcatttggactgatttagagaatggagttattaatttttttaaaaaatctttttttctattccagttttccaaagaaattagaccattttcttcgtgagaaagaaatcgacgtgctgttttcatagggtgagtgatcctttgaatctttcatgtatttttacccacatcaaaatattatccaattactatgatgcaccaagaaaaagtgtgtgacagcatgcactctctagttttctcctgcttggaaccaaggtatttttcctattctttgactctcctcatcactgggtcctttggagaggatggtttcccttgtagatttttctgcgatttcttttttgccgttcacatgctttgcctcgtgcgaggtcatcattgttgctattaccttgtccagctcacagaaaggaagtttctttccctcagcaactggtgcacagagatacagctgtaggcaagggggaaccatccagtttcaagtgactgtgatgtcttttgaattccatgaccaagaataacaggatatgagcaccagatgagacctgagagcttgtctggcaaaggccctatgtacagatggggcatctgaggcccagaggctcacatcacctttatggggcttcatggagagtagcagagctaggattttgatactggtgtgtttggctcctagctgcatgatgtttgccctgcacaagtctggttttggaatctgcagattctttttgaggctgtagagttataggtagtttaacttaatgtggtcttggtaatctaataatgatcacccctaaggcaagggtcaagactgatactgatagactatttgactttctcataatcctagttggctactaagtaaaggggttggcagagtgagtgcacccagaacacttctgttatggatgtcatctgagaaagcttattttcttctgcgccctttccaaaccactgcatctgcaatgccacgttgtcatgtgctgagacttggtggtacatctgctttgcagctagaagtcatggtacacctgcaggtgtgtgcagtccagctgcagacccacacacccgactcgcggttgtctgcacctgcagaagaatggctaacagggttcctatattgaagtacaaatctgaccttcatagagacttttgagaaacatttattcttttattttatttgtttatttatttactttgagacggatctccctctgtcgcccaggctggagtgcagtggcacgatctcggctcactgcaagctccgcctcccgggttcacgccattctcctgcctcagcctcctgagtagctgggactacaggtgcctgccaccatgcctggctaattttttgtatttttagtagagatgggtttcactgtgttaccaaggatggtctccatctcctgacctcgtgatccgcctcggcctcccaaagtgctgggattacaggcgtgagccaccgcgcccggccccatttattcgttttttttaaagttatgttggtttttacataagagtgcagttgtgcaataagatggagagaagttaagaatatgattctcagttagaatcccagaaggtaaacttgactgtgtgtgtggtttgtttgtttgtttgtttgtttttttagacatcctaggttaaatctggcttcaaattgtgttcatttaggttggtgaactaagtgcacttatttccaaaacatttcatctcacctagggagtggtcaaagggtagtattaagagcttgtgtttattattttatccaacttgtcagcttaatcactttgtcttcttccctaactagagtcattattgcggaacttgatcatctccttatgtacatacagacgtaattggtgtctaccaacatactgaatggaatgtagaacatagattgctgatttgtgagggatcatctgctgagttaccctaacattgatcgctcctgtccacagagctgggtctacacgagttagcattcattagaactgtgaaggtttccattttcctgtcttatctgagaaaagcccaaaaagtttattctcagagcacaccacagtacaatgtgggtcactgacacctgttgctctctggggactgtaaaggtctctttagagtcaagagattaattagactaaaagaagggggcaattaagggccttgagaaagtgaagaaatgtccatttccatgcttacatcataggattctttgggtaaagaataaactggtagagaagggtctgaggcaagaaatggtgaaggaatgaaagaaggactgcctgaacccatgtagaccacttgtggctactttggtttccttctggggtcatgagcactttgatgttgacattcaagagggcatcaaattattatccaaaatattacaagccgtaatttttttattttaccaaatgagaaaaaactaaacacagatagaagccatgagtatttttctccctaaaaagaagctcagaagctggcccccacatgcatatataccttgtaaaacgtgagtccctgggctcagtttcatggtatgcaatggggctgggtcttgggaacaatgctgctgttgtttctaagctcaaacagcactcaccatcaatggtatctctttaagggaaatccagggaaatgctcttgccagcgctgtgattttatttgctagaggccaggtggcaatgacatgcattggttccatagcaacgtgactgtgctgccagaaaacatataatgactgtgacagccagtgtatcctgggcaggatgagggcagccctgataccctcttttatttcccaccttatcctctcttgcctttcccctcctggggcctgtgatatgcggagaatgtggttttcgtaatggttactatctactcttgctattaacacttgcctcctgtctcggtccatcttggaacttgatgagagacaaggcaatgcctgtaggagtgttctgcaggcctctgaatgggtcagcagggttggcagcacctgcctgtcttagcaattgaaaggaggtggagagtctgtgcttttcatcctccctgtgtgtggcacagcggctctgtcagaatgacctggtggggagggtacttcctgggcatcgtggtcagctgctcctggctgaaatgtgtgggtagtgacatggagcaatgtgaaatccagggaaacagagtgctcatttaatatgctgcagattgaggagacacctaccagtggagcctgcaatgccaggcccagtaggactgcacagagaaatgcaatacccatttctcatcttctgggagctcttaccagagaggcagtttctaattgcagtttctctactgatgtgtggttggggctttcacatttctctaatgtttcctcatctatataatccttgatgaaagaattgtaagaactcttagttccaacggatactttttttcccctctgaactcctgaagcatttttaaaaatctttaccatccatttgacattgctcttgtatttccttttttcatatatattgctttgggggcctgagtgttttctaggtcgaggctaagcccttcaaggatacgaaacatgtatcttcttcttcctcttaaaaaaatttctctaatgctcacaactgagttctgcagatagtaaccatgacattaatatttgttcacgacaacgttatattctcactccatctcccaaggaaattgtgaggcaagtgtgtaaatatattgaaaatgttgttcagttcttcaaagaaaagataaactcaagaaattattttcctaatgtggtttttttaatgcagatataaagtcacaaggtaagaatatctaaaggcttcatatttcctcatcttcctctttctggctactgaccatagcatatacccctgggttttatactggcaccaaaatcatcctttttcccacctcactcccaatattcactgtattgaatttgtctttgggatcagacttctcagtctagcgttttggactattaagtaagagatttgagggatttttccattaagatgacagatagattaggtttgatagattaggatagtgattcctaatttggttttgaggtctgtttaggggagggaaggtttttatcttatggaaacttttatcttacaagagttctcttcccgtcccaagttctgagcccactgagaaataagacaagagtattgaggcagacgggggccagaatgcaactatgtgactgagggcaatgagctaacttgacacctgcctgttccccagtctagcctggtcgcaggccacctgcaggaaagttttgagtctacaggcacctgtctgtgtgaagagggaaggagaaagaggcccaaatccctgctaaccctgctcaaaattatatagattcaccctatccaaggagggggcataggccacgttggctttagccccagccgggttactcattccacacccttggggaagaaaaggttggagcaagaggtcagagggcataagggaaatcctcccccatagaaagctggggtggggcgtggcgtttccttcctgctctggccatatttctgctccctgcaccccatcaggcctacccgcccccagctcactcaagccttcttacctgttgttttcttcgtggcgcttgggcttctgcatccgactgctggtttattgttagtctcctctattagaattagctcagtggaagcaaaagccttgtcggtctcatggactgcatgtatcccagtatttaaaactgtgccaagcacataggaggcatttgatcaatatttgttgaatgaataaacacatagatgttgtttgatgcctctgctcacactctttaattacctggacatccctggtgccctgtcttgtctggcaagtctgtaggagctagttcagcaatcgtggtctcttcttgctctgtatgtagctcatcagttggcagtagttggcatgtgtgcatgtgtgtgctctcatgtaggtgagtgtgcatgtgtgtatctttgtatgcatgtgtgtgcacctacatacctgtatccttttgtgcatatgtatttgtatgtacttgtgttctctctctctctggctctgtaatacttcacttatttgtttacatatcttttacccttactagattgcaaatgcttgaagaactggggaacctgttaatcattcttgttcctctaatatctgccatgtagtaggtgctcagtatatgataatattagcattctaagcacttacaacatgcccagtactgctttattttaaaatttaaaataacttttatgtatcttgcatatattaacttgtgtaattctcacaacaaccttacaagatacattttaaactcgttttgtgggaaaggaaactggggacatgaagaggtcaagtggctggcccacagtctcacagctagcctgactccatagctttttttctctgctacctctcagaaactgactactgtatttgtgtgaatgaacaaatgactgaatgagaattttagaagcccagaccaaaatcattaaatagacctaaagacattagggtcaacacaaataagtaaaaatgatgagccatggttgacacagaatcaaggccatggctaagataaattcacagatgaatagctaatgccttcttgtagccattgcacttaattcctgatgatccatgcctgcatggtggtattggttaatgcaaatgaataattgttattacgtattgggaattatttcctagtgggaaaatatcaagtcatcagttatgagttaagcagctactgcttgcgaggctcacaactaaattttggggaaaatgatgagaggaaggaaaatgtgagttggagggtgaaaaggtaagccctgaaagtacaagccaaggtcactgtcttcaagaggctcttgtctcattaagtggcaaggagtgagtaaaagtgacattaaggcaattaaaagatactgagggcagtaaatataaagcctagcacaaggcattgttagacatgattcattaccaaatggtaataatagagaaaataaaagctattgtattagtcaggataggataagcttttgttgcagaaaggtcaaccctaaactttcagtagcttagcaaaataaaagtttatttctcattcatacagtgaccgctgtggatgcagtatctctccaggacaactgtcctccatgcataactccatgatgcagtctgctttgatctttttatccagccatctaggggcctctttcatgatcactggaagagagaaaaattggaaaattgcaccagcaattcaatgcttcaaagctttggcctagaagggacacttgtcacctgctatgtcctaagcatggcttttagctttttgtataactcccaacgtcccagtcctctcacacagcacacagtaggtgctcgataacgtgtagggtaaaagaatgaatgaacttaagaatgcattgtgacttgctcctgatggtgttgtagcagtaatatacctggcagcccccaaagcccaggcttggaacagtcagatctggctcaaaaatatttactaaaattaaaagagcattaataaaaataacaacatagttaacattaattagctatggtgatgggacaatcataaggacacgggcaaattaaactcaatttagcaggtggctaaacttacgctaaagccccggcctgccagacattggccttgtcttagacacatcactgtctaacagtccagagctcaactcacagttcacaagtcatctggtcccatcttgtctttctgaccttgttcctcctgaatgagatggagatcattaggcttgttaaaaattaagaagctttattaaggcaaagttaacctgtctgggatgcttccatgattccatcccaggtgtatggaccaccctataccatccccctcctgcatccgcttctctcatgctttcatctttcatctggggtcctggtgaacagaccacaattcagctccagatcaacgaagaggggcttccagacaggggccacgcatatgctgaggaaaacacagcaatctaacatgtaaagtaagtgggaagctccgtgtaggactcaacacggagaatggacagctcatagagagaaagggggagactgccttggacagggagataggggtcacaccacatgtgtcagaccaaagaatggggacccctcaaccacattcgctacgtgtgtattatgtggtgaagagaaacctgcctgcgaggaggactgagtcccagccactgacagattcccaggacacggtgcttcttgttggtttgtggtttgggggtggtagtggtagggagggaggagtggtcactgtgtaaatgggcagtgctgtggggaggggtcctgaactgggggttggcagtcactggagatttttcaacaagttggggatgtgaagaaccatgttttagtgagatgagctttacagctgtgtccatatcccgtgagatggtggagaaaaaagagactggggtcccagagggaaggcagttgcaggcgtaaggagataaggttttgagaactactgtgggcgtgttacaaagggaccgatgtggaggacactacaaagaaagagttgaacaaactgagcaactgggtattagaaacaatgaaaggaatggagtcagagataacccaatttttgagcctaggtggctaccgaaggtgtcctgtgttgtactttatggatattattattattaattattattattattattattttgagacagagcctcgctctgtcgccaggctggagtgcagtggcgtgatctcggctcactgcaacctctgcctcccgggttcaagtgattcacctgcctcagcctcccaagtagctgggattacagcctcccaccaccacgcctggctaattttttgtatttttagtagagatggggtttcaccatgttggccaggctggtctcgatctcttgacctcgtgatctgcccaccttggcctcccaaagtgccgtggatattattttaataacagtgtcatcccatgagatagagagcctgtggcagaacccagggattgcctgggacccagatatgcccacgtgagtatctgagttgccttaaccccacctcccttccttcgagccctccctccccaaggtttaggatcaaatcttaaatcagcagcaaaactgccaggctgaaatttcatctccatcctggccctctagtggagataaaatggtttgaatgtgggcgagaaagtaaaacggaatgtgtggttgctgagtctagctgttgataagagagggttcaccatccacccatgagaactgtctctctcctgctggtgtgcctcgctctcagacgcagcctccctatggctctgggacatgaggggtaatgtcttgccggttggtaaaattcttgcaagctgacagtctttttttgtttttcttttttttaagctccacaaggctactgcacattgcgttcttgctctttgtgatccaacaagagggagtcagttttgatttgggagaaaggaggaagaaagctgtttgatgggcgagaggaggcatgtattgattgcattcccgttttgctttctggggctggctggtcatgtcactcttcatagctgcctggctctagtggtagaagagagtctaatgagagacgctacggctgtgtgcagcttgcacacagcaactcttcagctccaaggaatcagagtgagctcctgagctccctgggattcagaggtgcctcagccccaaatctttttcccctgcatttaggctagaacaggaaagatgctactgggagagaagagaattcctgacatcttgcctttcttgtctgctttctgcttgggtctgtggagcagccacctctgggcagaggtgcaggaagtgtgacagaacaggaaagctttaaagtcactgtctccctccctcccatgccctaggctacccttgctggtcagaacctcctgcttactctggtggacagacacctgagttgctgctcttgatgaagtttctcccacttcttcaaaccagcaaggcataggaccccacttggcttggaagacacgtgacgctcttgatcatttcagtcccttttacatccccataatatcaccgtggcctgttagattgatttgtgagtaagattccttgcaaatagcaagatgatcggaagcctctatcttttccgggggaggtgcatatttaaacagacagcctaagctatttatagattgtaatgtattgtgttacagggaaaaggtggaagtcaacagtaatgttctgttccccatttcctatagtttcaagcatattttcttgctagtcctagagactttaaacatttagaatctccagtgatatctatattcttttgatgtactttgtgtagaaactcaagcacgagcaggcttcagagtcagctaaccaaagaatcttggggcttttgatcactttccattagcacaaacagtgatctctgccctgttgtatattgtttgaaaggacatttgctgtttaatgaagataaacatgttgctgggtttttaatatgtcttctcaactcaggagctgaaaaatgcatacatgagattagttctgttggcgtagaagggattctgcgtgccccaaacattttcctagccgttggctgaacttttgaaatgtgctttgcactgcaagaacagatactgaacagatattttacttagaaagccttctgtttcaatggtgattcccaggggccactcaaccacatcttactaaataatatttggtcaaaagagaaacgtgagtgcaagaaggacacatgatcacagccactaacaaattcctagaaagtgctgcttgttgtcatttctggttaggaggtgatggtgatggcaggtagagggtctaagccattctcctgtctctcttttaaagtacattcttctgttgctgtagctcctggcattggctgtcaccctcacttgcaggagggagggaatgactgtttgttgctgttggtgtctgaaaatctgtgggcagaacttttagaaaaagcagaccacagagcctgctatatattttgttcagcccattctatttctcttcactttttaaccgattgcgacaaaaaaaggggcctgccttctaaacttgtctttatctttaaaagagaataccttttataaatgcttagaacttggagatgctgttgtttttatttagtatttgaaaagctaagtatgctgacactgtcctgggagtgcaggcccctcattgagagagaacagtaaacacagcaatgactttgcttttaatttgaaatgcgttactcttcttagagctgaggggtgatttgagatgttcctgttttcacattcagctatttcctggttctgtgatcataataaattccatagctccaaaacattagagcaaattgtgtcttctgtaggagttatttacggatactcaaacaaatggtgctttctgaggaagaagaactgtgtatgaaaactatgtggtaaagcctttcatatctgccgtggtggcagaacttctgaggagctggctttgagggtaatgatatctttatcaccctgacgctgaatggaggcggggaggcctttgtgtgttctgttgccaactaacacctggctgcctcagggcatcctgcctggtaattgaacccatgagtatgtacaaagattagagggaccgtttgaggagaaagatgggggctggagaggcaaggttagtcttgccattataagcttaggtgcagaaggaagccaagctacctggaaggccacctcgtggcaaagacacccactaaggcagggcggtggcctgggactgaccatcaatcacttcccgctcattctcctcagaactgaggactgttgtcttcagtcttccccagcctcgcttatcttcctcctgcttcctgaaggaaatatccttttgcaatgggtggactatcaacttgaatttttagcaagcaggctggagaagtttttggaagttttggagacatggctggtcttgaattcctgggctcaagcaatcctctcactttggcttcccaaagtgctaggattacaggtatgagaagtttttggaggtttcggacttgttgctaggttgattctgagggagaaaagacctctgttattcagaaggttgtggacttctgaagaatggaaatcgggcaccctgaaggaaacatatgtcaatcctagtcctggagctagcatggctcaagtttattcccttaaatgtctattgtgttaaaacataaaaagagtttagatatacttccacatctttgcagttgttagctctctggacatttataaagggaaaggaagagtgaagcagagccccattaattcccatgcatggtgtctgctgtttgaatcctggaaatcaggatgattttattcacatgttaatgccctctagtggctagtgaggtgccctctaagcaggactttccccagcttccaccccttcctctccctaactaaattaagcacccactttacagtagttgagtatgtgtcatatcaagtctgtattttcttactaagattcatctaccacgtgggaaaaaaaaaatcaaaagctttgttacagttcaaagaacgtagtgctgttgctacatcaagtgaggataaatcttccatctgtagcaatctgtattataagtctactggatgtgacagaaaactctttaaaactttgatgcacatattttcacagccaaccgatttcattaaagtgggagaagtgtactattggcaagcagtttttctgctgacttcccacccttaaatagacaagctttataaaaagacaaaatcttcccagatctatttggttggccaaggtgacatttgtcttcctccctcagaaggttggtaaaattaaccttctgctttctgtatacctttactgtatttttatttctatttatttatttatttatgagacagggcctcactctgtcacccaggctggagtgcagtggtgcactcacagctcattgcagcctcaacctcctggggttcaagcagtcctcccaccttagcctcccaagtagcttgggactacaggtgtgtgccaccatgcccagctaatttttgtatttttggtagagatggggtttcactgtgctcctctggttggtcttgaactcctggactcaagtgattctcccacctctgcctcccacagtgctaggtataagccactgtgcctggccctagttttatataggtaaagcattagtcactcacaatgatctttgaatgagttatgtaagttatgtttggtttctcctactttgttttcctagtcagttcaaccagtcaagtatgagatgagtggctgctgtgagcttgatcaagtgggtcggaatcccctgggaatattgttaaaatgcaggttctgatcctgtcggtctgagatagggcctgagatgctgctggtcccaggaagacactttgaggaacaagttgctaggtgatgcagaagacagaagccatatttgattttcaaaaatcctatgatctgaaaaggaactaggagaagtatacaaataagtatggcataagacagaaggtgataaactgtatataaaagtaaaaacacgcttcagagggttaaagatagaagtgatcacttctgattgggaagatcaggccaatttccacagagaaggtgatttgggaatgggattttagtttgcaacagggattgcggggaggcgtgcgagggccattgagaccagagacgcagattctggaaagtgaagagtacgttctggaacaaggggccacccgtatgcctgtgatggggaaaagtgggagataacagttgggaaggtaagtggaagccatattgtagactgtcagacagtctgggatggaaactctggacttaattcaggaagcgaagaggaaccagcaacaagagattttgaaacgagaaagaagattgaaactgcagtttagaaagattcatctggcatgtatatgtaggatagacgggagtggggagtgacagcccattccaagagaaggagtagtagataggacagatagcatgattactcttagcaatggggaaaatagagactagatgcgatacagagagagaaggatcagaaggtgtccaggggctgtcagagtttcagtcctgaatggctacagaattaccataaataggacagtcagaatgagctatcgaatgcttttgaatggaaaaatgacctgaatgagtgcacaaatgtcacctccaagaggccttccttgtccatcctatctaacatagtatgccggtcttcttaccctgctttgctattttcatgacactttttactgtgacattaaaaggatggcaagaaaaacagggaggccaggtaagaaacctgtagttgacaggatagaaaatgacagtggcttgggcttgaatggtggcagtggcatcagagagaggtagctgggttcaagatacagcctgatagtatccagtatattctcgttgtgcatccagtctcagctgtttgtgtcttgcaaaactctgtacccattagacaataaattcccccttcccccttccccctccctcctggtaatcaccattctactttctgcctctatgaatttgactgctctagggacctcctatgagtagaatcacacagggtttgtccttttgtgactttttgtttagcataatgtcctcaaggtcatccatgttgtaacatgtgtcagaatttctttttttaaggctgatgaatattccactcttgtatatatcacattttgtttattcattcatctgtccataaacacttgggttgtttccaccttttggttactgtgaataatgctgctatgaatgtgggtgtacaaatttgaggttctcctttcagttcttttgggtatatacctggaaatggaattgctggatcacgtggcaattctatttttaaattttttatgaactgctgtatcgttttccacagtggctgcaccactttgcatttctaccaacagtgcacaagggttccagtttctctatgtcctcaccaacagttgttattttctggttaaaaaaatgtatttgatagtagccatcctaataggttggaggtttgagacctttttttaggggatatttcagatagacagttgagtcttcaggcctgcagctcaagaagtctgggcctgcattataccatagaagttcatatttatgccatcctttatcctttcaatgaattttttggccagtttgtctataagcatttaaggatttagagatttctattaaaccatcagatttgtgcttaaattatttaatctcaaagacattttaaataatatatacattaatttagacatactgctttcttccactttcatattatatgaaataattttacttacaacttttatctactatatcagtatcttcctcacgttttgaactacatggcaggtcatgtagtatcgttttccaaagcacatcatcttgacgttcatctactctgtgtttgatgctattaccagaaatttcatcctaagccgcaagtgcccattcctatattcgttggttacatttgttgagaccccattggccaaaaaaagacatatagccaagcccacagttaatgtgagcatggctatagggaggcatcctacattggggaccattattgtcacaatatcctaaaccatattattaagagatgtttttcttcattcttcctgtgagtgtattttgatgaactctgcaacttaaccacttactgtgttgcttttaaaagtaatctttaaaatgcttttttatttatagtgacatccagtgcttgcaactaggaaagtcatacttccaagaataattactagtcaaatttgttttcttccattaaaaaacaaaaggaaaaacagttctgttaggtggctgttatataaacatgccaaactagcatttatcaaggtagttttaaggtaatatgtcttccataaagactactttatttaagagaccaatagatacaataaactttgtaagaactcaaaaattaagggtacttaggcttttctgagggctttctttggagaaaaattaccttatattatattaccttttattcaggcatacataataattgtaaatttggctttggagacttcagtcaaagaaagagcttctatacaggaaaagcccttaaacactaatatagtgattgagcccattgctcataaatgtttgctaagaaaaatacttgtctggcgtattcaaaggtcagtctttcctagaggcatgaggaacgtttcagagttccttcggacattgcagtgctgtggctggatgatgccacttacccatctatttatccatttatttattcattaacttcaaacaccttctatagtgcagagaatttctaaataccatatattagaaaatctttattttatgagtttggctgacaagggtaggaataacaacagatattaaaccaaaaagttttgcattactgaaaaaattggacaaattcatattaaaagttcctaaccaaaaatctcacagatatgatgcagtaattgaaatccatcatattctaaggcttaaagcatgatgatctgcttctacagtgataatttgggtaagaaggacagtgttctaaaaaagcagccttaatatataacacggaggagtatatgtattttggtcaccggccatttgtctgtccatccatccatctgtccattcatccatccagctgtacatacatccctacatcctttggtttatttcagtggtgtcaactcattacatggcgttgaatgatgttatcaataatcattggcatgccctttactcccttagggtagaagagaattaggtaaaaggtagtactgaaaaaatgttttcccctcttgctgcaaagttataagcttttgtttcctaatcaggcccactagaccacattttgccagtgagcctccactgaaacaaataatgataatgttcatttcacatctttgacctgggaattgcagagtgatttaccaacattaactcatcaattctcctaacacttctgaacaagacattataatatatcattgaattcatcatgtaaatggattctgtgttttccagagaatttcaatatcctggccaccaattacatagggagtgaggagaaaaattaaaacaaaaattacccttttctgaactactgtcttgtggcctgatctccatcagaatgtcttattttctggaaattttaaaagggggaggtcagaggagacatcagctttgcttatgtaaaactattaaataaaatcatactagagaaaaatcattagaaaatgaccatttcccttaaaccactttcttcatttgactcattgcttaataaaatgatgaacttgaaacgatgctgcctgctccatgtcacccaaatgatgagtcacatcatgtgaacaaatggaaataaatcaccagcgaaaaggccaaacttctgtgctaccctagaaatattttctatttttccagggcttccaatgatcttccattcctgtttaactcagcttatagtaagccctgatgccaagattttctgagttccctgccaaaaccatgatgctctcagcctgggcctctcttctaggagggaagacactgccctccagatgaagtgaaaaggagaatcacaaaaagaggattattccttatgggaggaaatgggacacgtgctgcttattgtaacatcattcgccattcgttgggtatatggaggcttttatgagaaagcagaggtttttataactcatttactctggcaagtgaagcaacactaaaattacttaagtgtttaaaagatagacgcatagtagtttatgttctcagtcatcttattactgagaccctaatttgctttcgttaaactgtcggttctccctgagagtgctattgttatcggagcctcataaccgtgtacacgggtcagtgatggtacaatatttccggaaatttaagtcctccataagtagtcaattgcaggttgttttaaggaacaaagactgcttttccagcaagcctggcttgtgttcctattaaggccccttcttttttattgcaaggggaaatttcaaaatctcattgctgtatttaactttctattttagtaggctgccagtgcacttaaccttccatataaagcttatatgcgtttatgcgttctttcccttattaactttttaaggtttgggatgtcagcctgacctaatgatagaatatgcaaaaatagtcctgataccagcaccctgagcccacctaataagggacctttttcatactgtttacttatttctgagtaacagaaagtctgatggtttggtgctggctggttaaattcaacacatggtaagcttgcctgttagtgaagaaggttgagatttgggctgccggtatgttttcttctttcaggcaaggactgagtggcttccccatgtgtgcctaggtgtccagctgaccacagctgagagggataagcagggattgtgtccagctgagtttgggcccctcactcagtggcctacgttcctcggagggtgtgtgtaattagctgctgagtagtagaaggcagtagccatgatcccagttggaaaatagaagtagagctaaagctaaaaaaaaaaaaaaaaaggaaacaggagagctgattgcaggaggaggaggaggtgggctcttgctattttctagagcctgaaccaaccatgcaaagtagaatagcaggtgttgcagctctttcccccaggaggactcctgagcctcgtaagaaggtcagagagctggttgaatgttggtgcaggaagcacgtcaggaacagcttaacactggtttaattttcatttcccctgtgttattttacacatgaggggagtctgaggctgagcgccgtggagaggtctttgtggggagcagttcacgtcagatccaggcctggtcacctcctggcctcatcccattcacctgagtgacttgtcacccttttcaagtccttttccttctttgctttttgcttctccaagtgtgagattggcaatgtgatcattatatgaaaaacatttaaaattaaaaacgattctgtgcaaatatgaaatagataccagttttctttgatttctgtagtgtcactgatgataatatgcactgtagattaaatgattagtttctgggggtgggggtgctaccactcttttatgtaccaatcatatataaaataagtcctgagttcagaaatgttaaaatgacaaaaatcacatggttgtcatatataagctatgtgtgttgtatacaggctgtttgacacacaggccctgttctttacaaggcatgctttctggaagcccaaaccagtcccaggagtgaaagctggctcctagcaatacatgcgagtaggagtcagtgagggcttaggaaaattatccaggaaattcattttgagcagcccaaactgctagctagtagctaagctagtaggcaggagtttcattgaccacatgtctcaaccacatttaccacatttcttgctaaagatgccctaagtggggctgaaaggcacaagatatatagcaggtgggggcaagggggaagtgaagaacctgggtaccccacaccctagatcattcaattacatttttaagaattttttaaatgtacgtatgttaaaaagtttcagttttgcaaaatgaagagtttggggggtggatggtggtaatggttgtgcatcattgtgaacgtacttaatgccactgactgtatagttaaaaatgtttaagatggtacattttatatttgtgtagtttaccacaatttttagaagtatatatgtaatatatatgtatatttacataaatatttttccctagtttgatgaaagtatattgtcatgtcatccactcacccatccatctttattcattcattcaacaaatatttatgaagccactgttaggtcaacatctgtgttccaagctggaatataactatgaatacattttctgtgcttgtgttactctgaggttagtttaagtgaaagccatatgaacaataattaccagccagcgtggtgagccaaaaatgaatgtgtatgtggagttaagactgtgtccagctgtgcagagttgtggggtgtcttggcatctgtcaaagagaagatggacataaagagatcacctgccaagggacagcatggacaaagcacagggaacaaacagcatggtgcagtgtgtgcagggaacagtcagtactccattggtggtaacttgtcatgaggccaggagcaaaccatagagggtctcataggccatgttaaggagtacagactcctcagctcggtggaggtcagaccacattctccagtagcctgaggatttctcagtctcccaacctctgccctgtgaacctctgtggggctgccttcagaagtacttggtggtgatggatgaggagtaggaggaaccgataaaactagatagtgtaagtagcctcaattttatttatcttgtgtattagatttctatataagattttgtttgaaggcagagttctggcttttaaaaaacacatttgaaaatcattgctgttggcaatgaggaatcataaaaaattattatagttggtgacgattagcttagtgttttaaaaatcaatattctgcattcaaagcaataaaccttctttctccatttctgaacctcacctcacagtactttgcacatactaagcattcaatgaaatgttcagtgggaattgttttagggctatgacttagggatattttcattatactactgtcataagggtccacttaaatagaatgttgcccagtaactcaaaaggaatttgtagaaatataaactatataacttgccttttattctcacttttctttgtgtgcgattggactgtaataattattttttctgagttttcttgtctatttctgagacatcaggttttataatttgatgctttggacctggttgacaattccgattctgtatgtaggattgaactttgtgggaaatagcagttaattgtattttttaatgcttaaaatgatattctgggcaagttttgtttctttacggtctatagccagaatcctactgtttttcaatttgtttaaatgcaacagcttatacagcatatgtacatgttcagttgaagataaaggatatcattatttttagcctattacaaagaaaaccacattttctcttaaatgtcttgatataaagtaatttgaacacaatttctgcacaaatcattttcaagagattggctgtcaagtgtatttttttaagtagcactttcataagaaccaatgaaactttgcaaatttagatagattctaagcctgaaatgtggttgaagatgtcagtttttaaacagcactttgagaagtagttaacttaaaagtatagcaattcagagcatactgagaatgattttgaagagtaaagtcttgatacactgaaaagaaagttgacagattcactacaattaggagacaaggaggtacaactcccacttgtgaaaacttttctcatctaaccaacttctaatacttgcctaagaaaatcttcagcaaatccttactcctttgcagctcctaaatctattgtatagaattcttccagtttcctaatagatgctggcgaggctgtggagaaataggaatgcttttatgctgttgggggactgtaaattagttcaaccattgtggaagacagtgtggcgattcctcaaggatctagaaccagaaataccatttgacccagcaatcccgttactggttatatacccaaaggattataaatcattctgttataaagacacatgcacacatatgtttactgcagcagtatttacaatagtaaagactggaaaccaacccaaatgcccatcaatgatagactggataaagaaaatgtggtaaatatacaccatggaatactatgcagccataaaaaagaatgagctcatgtcctttacagggacatggatgaagctggaagcctcattctcagcaaactaacacaggaacagaaaaccaaacaccgcatgttctcactcatagtaggagttgaataatgagaacacatggacacagggaggggaacatcacacaccagggcctatcggtgagtggggggcaaggggagggagagaattaggacaaatacctaatgcatgaggggcttaaaacctagatgatgggttgataggtgcagcaaaccaccatggcacatgtatacctatgtaacaaacctgcatgttctgcacatgtatcccagaacttaaagtaaaatttaaaaatattttaaaaataaagaattcttccagtttccttatggcataataatggaaacagaataataacatgacaaccctcctttccttgttttaaggaaaagtaagttgttaggcctgtgaacaatggcagaactgaaatggagtcttcactcaagccttgtgtgtgattgtgtgtatgcatgtgtgcatgcgtgcatatgtgcacactcacgcacatgcacaaacctacacatttgagtgcaccagtttaaaataagagaaaaaagtgacatgaaactcacttcccaatttctaccatcattaataatacattttaccaattctgatttgttctactattgtgtcaaggctagttaatgtgccccatgcattggcagacaagatgatattatgtggaaattgtgtcttgtctattataagaacctgaatatttaagtatgggagatttttgcctgatattcttcagtcttgtcactcactactgattaagctttgtaatctatatatgggcattagatgaatccataaatgaatgaattggtagtttcctcaatgttttttttttttttttttttttatcataatgaagatatttcatgaccttttaccagtcttatcacatcttggaaagaattactacatctctgaaaaccctacccaggtaccttcttgtagttgggccatatgtttctcaattcagatatacccttgaggtccactttccttaggtggacatacacttatgtacactcacacacccacatgcatacaatatagagaaagaaaggtaaatagtaaccgacagaggtagtgcctgctattctcttcagcgagttgttatcccctcgtcccattccacaagatgggtgccacattgaagatgcaaccaaattacatgcccacactcacagtggttggcccttttgaaattactgggagattataatgatacagactgtggggttgaaacaattgtattaaaatcaattttctgccacttccaagttctgtgatctagggctgtcgcttaattaatctctcagagtttgtttcctcgtgtgtcatatgggaacaataaacttactttcacacggttgttgagaagagtgaatgataactgatacaagaaattcaagttttgttagttttaatcggacatcataagacttttaaaatcatgtaaatgtacatccctaattgcttgcaagtggtgcaaggtgacaagaggagccacctttgtgggaggagtaggtggcaacctctgatgacttcaggacagtgactctccaccttggctgcatagtagaatcacttggggagctttccaaaattctattgcctgagccataccccagaccagttaagtaaggatctctgtgggtggaacccagacattagtactttctaaatctctctgggtggtcacaatgtgtagccaagttggagaactgatgctttagggggatttaaaagtcttcactccttgcattggctgaattgatgatagccagaattctacaacctacactgtattctttttgcttaagataaacagagtcttaggtatcatgccaaaagtctattatttctcttggttatacacgatttggcatgaattagtttattaagttttctccaaagagccaatcttaatgggtgggtgtcgggcttggaaagagaacagaggtctgtggatatctgaagacaggggctgttcactagaggggcacaaacacagaggcaaatgcaacccaaagtcagcaatttcaagctactgttgcttttgaaaattagttcttgcaaaagcaccacctcaagaggtggttggcttccctgaaagctcagcatcatggctctggtgggtcatcattcatgaaaacttgctgcatctttaaaatgtgggatgaggaaaaacatttaaatagtggctgaatacagtcatagtgtaaccaaaagccagaaaattaatttttaaaataatgtatatttttaaagttttgttttttcaagagaaaagactaaaatcacttcatactcaaaatctctcttacctcttttcaacaattggtgctgagacaatggaaaaagtcacctgggacacatgccagagaaagaagttgaacccttacctcacaccatatacaaaaatgaactaaaaatggatcaataccctaaatgtaggaactgaaactataaaacttttaaatgaaaacaggagtaaatcttcatgaccatggatttggcaatagattcttagatgtgacaccaaaagcacaaacaacaaaagaaaaaaatagatgcattggacttcatcagtatcaaagcctttgtgaaccaaagggcactgtcaagaaagtcaaaagacagcccacagaatgggagaaaatatttgcaagtcagtatctcataagggtctagtttctggaatatataaagaactcttacaattcaaagagaaaaagactaacaacccagtttaaagatggacaaaggcattggatagagatttctccaaagaagatatataaatagccaataagcttatgaaaagatgtccaacatcattagtgtttaggggaatgcaaatcaaaaccacaatgagataccactttattatggtcacccattatgatggccataatttttttaaaaaaggaaaataacaagtgttggcaagcttgtggaaaaaatggtaatcttcctacctggctggtgggaatgtagtatggtgcaatcactatagaaaacaatttggcaagtcctcaaatagctaaatacagaattaacatatgactcagtagttctgctcttaggtatacactgaagagatttgcaaacaggtattcaaacaaaaacatgtacatgaatgttcatagcagcatgattcatagtagcccaaatatggaatcatcccaaatgtccatcaactgacgaataaataacaaaatgtggtatagcctacaatagagtattattgaaccaaaacaagaatgaagtactggtacatgttacaatatgaatgagccttgaaaacattatgccaagagaaagcagccagacacaaaaggccacatattgtatgattcagtttatacacaacatccagaatagacaactccttagagtcagaaagtagattagtctttgccaggggctgagaggagtgggggacagggagtgactgtttcatggataagggggatgatgacaatcttctggaattagatagtgatgatggttgttcaacatgtggatggagtaaaagccactgacttacacactttaaaaacagttaaaatgctgaattttgttttatgtgaattttatcttcattaaaaaatacccctttgaccccatctcttctctaatcctgcacatatagccttaaaccagtcattttaccctttgtgattccattttcatcttattctgttttttcctctaatgttcaacttctgcaaagagacatctacactggtcttcatttcctttccagcccttccattcatcactccagattctacacctgacctggaaaggtctgtgttaactcaaacagaagcttgggcacctcttccttactagaagggcattccagtgattgacattagaaatcaagttcccagcatggccctgccaccaggctggactcgtccattgcactgtcaccaaggaatgttaagtcttggaaacagatggaggaacttgcacggcgtttcccagcaggcacaggcgattcctgcaaacttaggagagtgaaagtcacacgaacaagaatgtaaatttgtgtgagaagacgtgatgctgttactagcagagttaaagtgcttttaactttggataatggatagtctgctctgattgcctcgaaggtggatctccaagcccacagaacggtctaaaagtggaaggaagctgtattaatcatttatttaattttctttctttctctctttttctgctggggtcagcaggaatgggaatcttttttttttttctttttacatcagtcttattatgattatgattatactgaaagacctggatgggaggaatgctgcaatctgaattaaaaatagcattttctgtcctcccacacacaacacttgagtgctctgaatgccttttataaatgcagactttctgcctggctagataaaagaagctgtcacttcatttccataacgaagtcattcccgggagaattccattgttttagcaatagaatttttgtaaaaggcctcttattttgcctgaaaaaggtaacaaaaatgaacttttgagagcttattcgacaaaacaattaagcagtgaagagagattttctccttttttgatatattaggagttgtaagtgtgagaatcccctgagccatgatactaggataaacccctaaatctgcaagatgaaggaggaggggagaaatcctgttattctttctcctaatagaaatggggatatgctcttccccgagaatatgtgtcctagagccaagtgacacatagatgatgctaattctaaagagttttaaatatttagtcttaaagagaggtaggaaacttgtagaatgctcatggtgtaaagaaattccttggggtttttaatgaaacgcgatcatcaggtattttaactgagtttcaggactcttaagacaaaccacggctgcatcttgccagcgtcctttactcataaaatagtagttgatatttttctttatttgcattgaaattgcagcaagtggagtacagggtccttcatgatgcagtgtgacctgtagcgagctcagacaggcctgtggacatgtggtcacactcagcacccctctcctgtgtttccccatccctccacacgatggatctgtgctccaaatatggtatcaaatcttcagcgccacattcatagaaagaaagaataattgtatttcttgttacttacccggccctgcgtaacccacatcaaagtatacctgtctttggtgtttcaacaggtaatccctagatataatgccaagtggcatttctgctacatggtattcacagttaagaccattgaaatcccagttttaagctagaatgcttttatgaagcctcctccaaaaaaagagaagttttcaatagcacctttgtcttgcaatactttgttctgattgagtcagaaaattgtaatatttaaacaaggaggcagttactcggaatagtattaaaaaaggagtttaaagtatggagttgttgtatctgttggcttttaatttagtaaaacaagtagaccaaaaagaaaatgagtgctgttgacgtaatattattatggaaagttctgtgggggcaaacattatgcaaaagtagttaaatctggcactgattttgaatttcagaaaataattctgttgtttttgagctttgaatggcttttactaatataccaataataactttttttttttttttgagagagagagagagagtctcactctgtcacccaggctagagtgcagtggcatgatctcggctcactgcaacctccgcttcctgggttcaagtgattctcctgcctcagcctcgtgagtagctgggactacaggcgcctgccaccatacctggctcatttttgtatttttagtagagacagggtttcaccatgttggccaggctggtcttgaactcctgacctcaaatgatccacctgccttggcctcccaaagtacagggattataggcgtaagccaccacgcctagccccaatactaattttttaaagcatgatttgatgtcccagctgtagccatgcaattttgcatggtagtagttcataaaaagaaaaggaagttgtggctttgataggatgcttccaaggtcgtgtttttaatacttttggtaaattctgttacttgtgtctgttcaaaaggacagaggttgggagatgcatatgtggattctgtctcttcattttatcttcactccccgtttggtactttgtgaagtcaggccaaataaaatagttgaagatactatcatataactctcaatattatggcaaaaagagaatgagaggaaaatatttagctatttcttttttaggatttttactaattgtgttattaaaaaggagcaaatagagcaggaactgaaacagacttaaagtcagaggactggactgcacacattagcatcttgcagaccttagctgctcatgatttataaatgcttcagaaattatcaaagcatgaggcacaggctgtgtttcagccttccccattttcaccaagcacttctgcaacacctaaacactgaccttttcaagcaggcatgaataaaactctcctctgggcagaaggtgcgtgatgactcatggcaaccagaaaggggatgtgtaactcgggatgtggagtctctgggcttctagacccagacctccctgtcttctggcccactgttctttctgttgtgctacagcaatacctgaaggacctgcgtgttgaacaaataaggccaggaataagttgtcaataggagcacatgacatcttgtctttaaaatactaatttcctgagacgtcgttctacagctgctcagcacagattgggtatttatcatctatatgttcaacttacattttattttcattttattcttgatatgcagacatacttttctccaatgtataattatatttcatagcaaactttgcactacgtccataaggagatgtaacctgcatacaaatacacacagcagcagtctctgtatgaataaatccttacctttatgtgataagccatgctaatgataagaagcagtgacatggatcaacatgaaatataatttttttaaaaaacctttgaggatagacatttttccagcatatttatctctgataatgtgttctttaggccggtactaattttggattttattccttgaacacaaaccagttaatatacacagagaatattctgagtgcatgctaggtatccaaggactgccagtttgtaagaaattttacaatggataactcccataaatgatcaaatgttgactgaacagggaacgcatgatattgtgaataaatcatattcttcagaataccttgagttttggcctacctcccacgctgacctccctccaactcttcttgaggtctaactggactctcagtccagccctgcactggagatgcctctcagtccagccctgcactggagatgcctctcagtccagccctgcactggagatgcctctccatgggaaaggggtgtttttggcccagtttgcctgccacttaagctccttggtgggcagggtggagacagggctctgcaccctgctgggctgagtgtgctcattcagaggaagcatttctgaactctgcaattgccagcagccctggcagcttctctttattcctcagaaaggaaatacaaagagttacctttagttctgagttggaaaaagaggctgttgtggaacatttcattgagggactgcacagtttccttagagacttatgtgatgatttttctccaagtcacccaaaagggtgttcttccatttgaacacctgtcctcttccatggaggacagagactcaaagacatataacgtcttcaagtataatgtaatataataccatgttatcaatcagttaatcaacaaatattgatcaaagagttatcatttgcgaaagccccgtgaagcttacaaaaagaagacagacataaaccctacctttacggaagttaccacattccacttggggagatgacacctattgtaggataaggaataaaatggttagtaacataaggaaaatgaattttaaaaccataggcattcacatgcaaaaacaaaacaaccaaaaaaaaaaaaaaaaaaacttctgattgagaaagttgtagaataagaggataaaagagttgtagaaaaagtgggatttgagctggtcttgggaggtctggcttacattttgacacgtggagtagaaatgcgggctctcagagaggaagtgagaagctcactgtggctgcttcagtgtgcatgaggggagaagtagaaatgaagttggaaaagcatgctggggccagattgtgaagatcttcagcatcaaataaagaatttcgaagatgttcagtaagctgtaggaaccaatgaaggtatggatggcacggggaagttgtgttatatctactttaggaagttcgatccaacagggatgactcaaatggtttagagagagaaagcattgacaagaagaccaatgagcaggctgctgtgagaggaattcagtctgagctagcatggggcggtgaagatagaaagggtgcagaattggtaggacttggaaaccgatggaatgtgggagaaagagtagaagatgatgatgctgtcagcttccatcagaaattaaagaggaggagctgggtttggagcaagggactgggaaagtttgaaataaacataatttgtttccactgcatatatccaggagtttgtagggggagataccagggaccaggatacagatttaagaacgataaacagtagaaggaaatcattatagaaagtgaatagaactgagcagatagccttaggaaatctgtcccctagagttagaaagaacagagagagcaaaaaactgcagaggggccataaggagtaatataaggaacccaagaaagtaccatctcagagaaattaagaatatttgtttattttggttacaatagacaaattaaactcaaagtgattcaagcaaaaaaaaaaagaaatgtattgtattatatgtggattggttttctattgctgtatgacaaactacaaatatagtgacttaaacaacacctatttatttttttttgtgtgtgcatcttttctttttttattttttatgttattattattatactttaggttttagggtacatgtgcacaatgtgcaggttagttacatatgtatacatgtgccatgctggtgtgctgcacccattaactcgtcatctagcattaggtatatctcctaatgctatccctccccgctccccccaccccactacagtccccagagtgtgatgttccccttcctgtgtccatgtgttctcattgttcaattcccacctataacaatacctatttattatctcacagtttctggaggtgcgaagtccaggcatggcttagttgaattatctgttggaggtccgaagtccaggcatggcttagctgaattatctgttcagggtttcataagactgaaattgaggtgtcaacagggctgccttattatctggagctcatggtcctttttcaagctcacatggttttttgtatttagtttcttgtggtcgtaggaccaaggtcccgttccattgctggctgtgagctgggggccactctcaggtcctggcattcaccttcagttccttgccatatgacttgcctcctccatcaacatgtcctctctcactttgaatctcattcctggtaaagccccatcccttttagggttctcttaattagatcaggctcaccaagataatctctctattttaaggttggttgactttggacctcacttatatttgcaaaatcccttcacaacagcagaaccttgattactgtcccactgactaactgggaagaggtgtgtgtctggcaggggacatggcaatcttgtgggctacgttagaatttggtctatcataatataactaaaaattccagggatcaggccgggcgccatggctcacacctgtaatcccggcactttgggaggctgaggcaggtggatcacttgaggccaggagttcaagaccagcctgtcttgaacatggccaacatggtgaaaccctgtctctactaaaaataccaaaaattagccgggcgtagtggctggtgcctgcagtcccagctactcaggaggctgagacaggagaattgcttgaacctgggaggcagaggttgcagtgagctgagattgcgccattgcactccagcctgggcaacaagagcgaaaccttgtatcaaaaaaaaaaaaaaaaaaaaaaaataataataataataataattagccaggtgtggtggcatatgcctataatcccagctactcgggaggctgagtcaggagtattgcttgaactcggagtcagaggttgcagtgagtgagaccgtgccactgctctgtctgggtgatggagcaagacttcgtctcaaaaaaaaaaaaaaaaaaaaaaaaatccagggatccgtctaacttctggcatggctaaatccaagggactttactgtcatcaggactcagattttctgtctttcagcttttctctgtactgggaagcttccttctccagtgggctttctgtaagaggtggctaaagaaaccagctgttagtagcatcatgctcccgtggtctcactaggaaagagtgtgttgctcctcttagttccaggtagtctgagagaggcctttgattggcttgccttgggtacatgcctacccctaggccagtcactgtggctggagggttgttgtattacgattgcccagacctgggtcatatgtccatcttccaggccaatgtgtgaagtcatcccagcccagataacagccaaggggagagatcattccagaaaagatgctgttcaggcaaaaatgctagtctactaaataaaaggaaaagaaaatggaaggaactattactagtgaactgtatcagacattgttagagaagttaagaggaggactcagcaaaggtcactgcatttagaaggcaggaaaccattcttgacctttggaggagaaggaaggttactaacacagagaaaagtggtggaaatcaagctccagagttttaagatgtaggcggtgaaatactggcattgaatgtatagtacaactgtttgttggtaaacagaagagagaggacagccatttgggactgtattagggtatggataaattcttttaggaatagcagtgactgagtatgcttggagtgtgagaaatttccagtagagaggaaaaagactgaagggaagttgggagcagagttgaccccagcaggatctggaaccagtaggaggagaatggattcagactccaagtagagaggccacacacagtgtaataacctgggtaatatagtgtgtgaagttttttgttgtttggtttttggtttttttttttttttttggtcatttgtcgcttctttgaaatagacaggtatcattgctttcaatgtagctatcaaatggtgattaaatgtactcaaaagatcctcagcatctctctggccctgtaattgacagaaacatttaaccttagagaagtggttctcaaagtctggtccctggaccagcagtatcagcatcacctgggaacttgtcagaaatacaaattatctgaccccaccccaagcctactgaatcagaaattctacagatgggtcttagcattctctgatttaacaagaccctctagccatttctattcgtttctttcctttttttgagtcggagtcttgttctttcgcccaggctggggtacagtggcgtgatcatagtgcattgcagccttgaactcctgagctcaagccaccttcctgcctcagcctcccaaagtgctgggattacaggtgtgagccactgcacctggccttctccagccatttctgatgctgcttcaagtttgaatatcactgcctcagaggtctgcatctcccctccacatgccatgaaggtttccttaatagtggctttgagaagctatgagagctagtgatgtaagctgctggtgatgaggaaatgggggagtttgtaaatcttgaaaggagatgacaactgttcaaattccactaatgacttaagatgtaatggattggaagaacagaatagaaaggctaagttgtaatttaattttttttgagtttgtggagggctgacacatgatgatgataggcatcatcagactttcaagtccctggaagacagagaaaggtgaaatgggcttaaagcatagctgtagactggtgattcttttggagtaagggttaagtcctagaacaggttttggatatggatcatttaagttaaatccaggctcttccactagatgctgttaggaggttgcaaaagaagggcatggcaaggtttctttcatcagagagcttagaaactttttgagccttcaagacttaaataaatccagtggagtataaaaagacagtataacaaagtgctgaactgaaaaggaccttgggtcagaatgtgtggtagagactgtaagtgctgtgggcagtcaggggaaggagaaattggcattgtgtcattttctcctctaggcagaggatgaaactgacagcctggcgtaatttcccaggtccgatggcaagatattggacaccttggcttcaggaagtgctttttcttgttctctctctcctttctgagtgtgtcaaagttgccaggtcaaagtgaaggtttatactctgagactttgaatgtggaatattgttaatatttttgtttgtataagaagcttgtaggataaattacattttatcttggacattttaaatggaaagagactcaaatagaagtttggcatatttgtttcagacaggctttcagacttactccattcatggggagaacatgaatgagcctgttggatgatgctttaatgttgtaggatgaagaaagcaaactactgattttccttagtggaagaattaagttgagccagatgtgggatgatagggaagaagaaaacacttcagatgaacatgacatttccactgcttttaatttctttgcaccttgcttgcggctcatgtgggtaagtaaacagaccactgaaccaagaaccaagagagaaggttgacggaacactgttaacggtgggcataaaagctgtttaagtccaagagagaaatagtaaaaataccgtaatcatcaaggggaagccagaaatctggtacctgatccaaggtcctaaagatgtttttcagaagtctacaagtaatgtgatctgttttcagtcctttttgggggagggttttcttaacttcagctgtggcatgcaggtgtcaacaagagagcttccttttacttcactgtgataacggagtgacttggggtgcattagagagcagggtcattatttgctgtcacatcaagaataatacctgcatcaggggtgttcctctcaccgaaattaatcacagagaaggtgtgtgttgctctgatggcctagcagtcagaaagatgaatcatctcttatttcaaggtatggagaacagttgtgtcactcatttctttttcaaggagactcagttgaaatggcaaaataaaaaagagagaaataacagaacacagttgtacatcactagatcagttcgtataatacagactgtttcctctacctggaaacctgatgcctggctaacttctgctcatttttgactttcctgttcgaatgttagttttgtaagagaagccttcctgagaccctccttctaagtgaggtacccccatcatgactacaaatcacaatgttcatttttccttcatattgcctatccagttttcaaattttatgcatctcctaaaactcatataattatttaattctgtccctcttgaggcagtgagctccttgggtgcagggtcctgggctattttgtttaccatgtattccccagttgaacacagagcctggtggatttagcaagtaccaagtaaaattgtatcaagcgaatgatttaattaatgagaaagcacttggtaaactgtattcattatgaaagtgatggttaattatgtgagtagcagacacctcctttctctcttctgtcccaattttgtctctccattttttattagttctttattttgagatatacttgtcagtgtgttaccaattccaaatctaagatttgttattattcattcttgcctttttttagagataaaggaccactcttttttgttttttttcctcagaaatgctattaatgacacccacaatgctaatactacaactgttttttctgtgcatgctcatgatttgaaaggaaaaacatgactggcctttgtcgatgatgtatttgggaagcaacaagattctagtgtagcacttaaattctgtttcttgtcatcctcaaagctgctaatacaagttcctttgcctcaagtgtgcttctcaaaagtatacaaggcgaaataagttgatagtatcgttccaggagaagctgttcctgggtcagccttgaaagggggaaaaaaatcaagaaatccaggtgtggaaaatattaatgatcaggatatgaataagtcttttcattaaaagcaacagcaaataaacaaaaagttatccaatccttttccagcagggcctcgctgtgccactctggtgggtgtaagtgttgtcttcggtgggcggaaatggcagacagccaagtggaaaatttcacagtgtcgcaaacattcagtgcacgaaacgctgcaaaccagcaatctgagggagccgtgtaccaaataaccacgctcctgcatgtgccctactgcccaccttacactctttctcctagcttcctgcgtgatgccttcactttctttttcccggagattccagattcttcgtttctgttcctattctttcctgaaactcagcacagtagggcatgcagacgtttggatgctcccgggatagttgatgattggtgccttaccagtgctggcttttgtattctggctccagagctcaggaacaggcttatgaccaccaacaacgctttgcattaacatagtggatttcttctcgggaactgtgtgtgctttgcaagaatgatcttcttgatcttctccatgacccagtaagatatgacagtggcagaaggtgctagtccttgcctccttttgcagaagagtaaagccaagtggcctgttttgaggcttttgcaagtttgcatctcagctaagattgtgtctgaagtctcccagaaatggcttcaactttggggtgaggagaggctggctgtaccatgttgtgttctttttgggaaaagagcaagaacattgaacttcttttttaagaaaatggtctttggtgaactatcaattcgtctaattggtcgtgagactgtatttgttcagataacaagtgatttgatgatgtgtttacctttttctttttcttctgttctatttccatgctaggtatttctcacttctctgtgaaaggaagaaagaacacgcctgagcccaagagccctcaggagccctccagagcctgtgggaagtctccatggtgaagtataggctgaggctacctgtgaacagtacgcagtgaatgttgtaagttaacaaccaagaacaatatgtgtagtggcttgccttgtaggattcatgaatcacttgatgtaaccgagccaggtgttgaaggggtattagcatgagctctaggtgatcgtccaattaatttctttttttaattggaagggaatttaattttttaagggaagaggtcctgtttgtatttgctggaacttgcctttctctcggcttctatggcatgctgcaaactatctacttcaggaataaaaggatggaatacagtgattctttcattgtaggaacaccttttctactggtacagtcaaatagtatcagatttagagcagcccctttaaactgggctgttgcagttcttttaggttggtgagtagggggtaaaattctccaggctaaggattagcaatcagagtttccatccagcaattattcttctgtatgtgcagttgatgaaaatgacatttttctctctggcttgtaaaatcttgaggtatgcaagttacaagcagttatgtttggtgcttcccttacttaaaatgagctgatttactggttttgatcagttactggcttgggattttgagattagtaaagtttgttcccacatgtcacctgatggccgccttgcatgagaagttttagtgtcaggtaatggaagagatgacatagtgtgacttcagggagcccttccactaggaaataatgcaaaggtgctcagccctcctactttctagagaatttaccttgttgctggactgtgtcacaaaacacagttaggagattttgaccaggaaagaaaatagctacatgaaacccaggatggcctatgaatacctctgaggacgagaagatattatcttcaaattttaggaaatgacaagccaatttcttctaggtttttgttgttgtttttgtgtatatataaatacatatatttctgtaatatatatgtatactcttgtttatgtatgtgtgtgcgtgtacacacacacacacacacacacacacacacacacacacacacacatatatatttaggtttccagcttcttaactcagccagaaaacttttttgaacatgtattacctattttttttgcagttgcctacaagatttgtaaagagcaaagtgtagcatatatcagggagaaaagtattgacaaggaaaaaaaatgttcctaatttttttggtttcatagatttctaaacatttgtattaaaatatgcatatgtatccatatcatctcctcagggttaaataatcagtaatattaatatgagcttattaaattcaaattttcccagtgcttcattgaaagcagacagtgggagacactgaagcttcattgtgtttccattctgtacacgttgggtctagtggaaatcagtcagcctggaatcagctgacctgaatcctattcctactgttgagatcaagtacactggcaaccttgggcaagtcgcgagcccccataaaacaatattttgcaagtctgtgtattgcttcatactaccttattttcatttttttctttttaattgaggtggtgccttactctgtcacccaggctggagtgcaatggcaagatctcgattcactgcaacctctgcctcccaagctcaagtgaccctcccacctcagccttcagagtagctgggaccacaggtgcacaccaccatgcctggctaattttttgtatttttggtagagacagagtttcaccatgttgctcaggctggtcttgaactactgagctcaagtgatcctcccgcctctgcttcccaaaatgttttgattacaggcatgagccaccatccccagcccatactacctttttattaagcaatcagcatcttggtttagggtcctcataaggggaagagcattgtgaaagcactattttacttatttttttaaaaaaaaccttattgtaaaagtttctgtcactatcaaggaataattgtgggccatgttagatttgggtactccagttacagtgtgttttactagaaatcattttcccaatcaggtaactgttagaatgcacttctggtggtattttttaaagcatttttatcctaggaaacaagtgtcttatgtaaaactgctttaggtttcaggctctatttaaataactcatgcagttaccataatcaagatagcttttgtttcaaatctagtgggggttttttgttgttgttttaaccgttgctttgaactgttcatgtgacaccctgtcagacctcaaagattgagtgaggttttcaaaggacttctgaagtgtacactttaagatgccacatggcagacttgaagtaattttaaaatccttctgtaaatggagtgtgttgagagagcaaggaaataccaaattctagtgaactctttgtgcatgctaagtactttcttttcaaaaccgcatttgcttggtaggggcagtggggggttcctagttttcttagtaaactgtgatgttggtaacctttcattatctgggcacatgtttacaacactggttttctgtcttcctgggtttagtgtcctgcatgccccaaagcctgtgccatggagaactgttgcagtagagaaggcaggcaattttcaaagaatgcatgtttgcacataaacagggtctaggagtgggtgtataaatgtgtgagtgataatcacagcagccattggaagtagtggttcccatgctcagcagtccttgcagatgttactcctggcattcattcctgtgcatgtcccattaactgcctctcaaatctgccaccacttgccagcagatggcctttgcccctgaagatgtttcagactggctgtaagggctggggggaggggggatcttgtacaagaagagaatgatgctgacactgaactcagagttagcagacctggattttatgcacaatgctgttgttagccatataaccttgggtcctctctaccatggggactcattttatgatggacaacttgagaaaattgagttaaatcacctccagtggtggtttttaccctaagtgtctcaagttgcataaagtatcagccttagatgaggccaattgaacgtttattttaccttcttgggttcctaaaaatcaatgatttggcactacctcatttacaactgtttttaaaacattgagcacagtcttagggttaaaagaaaaaaagagttattacatctttcactaccatgaaaccctttccacaagaccctcctgggcaccatatgacaattcaaaggtatttatttgagactgtccttagactatagctttagctgtttaaatttagggtccacactcattggtccttttgaaaataaacaggaacgatttttgaacttgagttttctaaaaccacctctgtgctcaaatattggttagagtctaagcaaggagaaagtgatccatatttcattcctaagcttctctgcttccttaagtaggaattcttgagttaccttatcaaagcagccttccctgatctacataaaatagcatccaccccatccctctcagtcctctagccttctgtgtttttcttttaagcaccttacatattatatatttatttgttaatcatcagtctcctcaactagtctgcaagctctgcaaaaggagggatggtattcttatccttattctcattcttattcttccctggtgaatgaatagtacctaaaatactgcttgttcccataatgggcagtcagtaaatattcattgagtgaatgcctaaatgacattcactaagtgaatgcctctcatgtgtgggcctgagccattaggaaaaggaacatacatgctgttctgatgagaatgcttgaatctgatagcagtttaagggtgtggggaagggatggagagtctagactattttccttagaagtggatacttgatgtgtataaagaaatgtgaggagggaacaatttgtgtaaaaaaaaaaaaattctagacctatcagtagagtttggggattttctaatactttttttaaaagtctgcactgtctgtatttcctctccttttccatttgagtggtttgctttgtcacttgtttgtgagcatcctgccctggctttctgtgaacggcggtggttttgtctcttatcatcacatcatttcatcactgcttacgttcatatttcttttcaaagtagggatgggcctgaagtgctgtatctccctagaaaggggctgactgaataacacttcattctagtgcacaccttagaatgaaaaaatggtgtgctggtacaaatgaaacccatttaatgtctctgtggtgtgtgatgggaagttcacaaaagctttcttagggaggcattgtgctagttagcttttgaggacagcaataataaaggtttctggaattttgtgtgtctatggactcccttttcagaataactgctctgagtgcaggcattactttattcctaggaagaaatggagagactaaaataaatacctctgtacctgtgtaaacagcattatgctgtctgtgtaagtcttaaaaaatgggagctgaatttctcttactctgaatctccagactaagagaattgcacacacacgcacactctaataagagcaatctgggaatttccctctgtgtctgtcagtttgtaccttttagatttgccatctgtgataccaaattctccagcgttacaaaaaaaaaatctgaagtagataagagggtcaggagagaaggggagattccaccacttttggacaagtgagggagaacaatctcctttttcttaaatccttgcttgtaatgctcctgcagattgacctacagattgtaaaggcagagaggttatgactgagctcattccatccaagtgcactggggatagcttcaagtcttctagagttttctctttcacccatttctctctcttcctcagacttccttgaatggcttctgattgacagcttcactagttcctggccattgcccctggtgtgttatttgggatgggcacctttggcagggtctttgcaggagtcactgcttctaagaagtggtgtcagagctacctcctgaggcaactgacaaagcgtagcccatcccaggcacaccctttcccctcagcaccttcttcctcaagtactcagctcctcctctcagcatcttggagaggaggaggaaaatgcaaagaacacccagacgttgtggaaggaaaaaagttcatggatcttttacaacatttgtgttctatggggtgaaacaacatcaacagcctggtcaggctgctttgtaactgaatagtgccaaggtaaaatgcttttgtgtcctctttaagtttagagttcactcaattacatgatatttattaaaagagtgttgtgtgccaggatgttcttgagtctatcagggatccagggctgagtaatctgtacttactgccctttgagactctaggaaggtgctatgggaaggatgtacttggtggcggagtcaggtgtaccgaaagggacgatgggtaagagttgtcagcgctggaatttcagggaagacatctaaattgagccttcaagcagaggtggaatttcaacccaatatatatgtgtatttagagaagacaaaggatgctttgagaagagactaggaatagtattttatgtactacttctgtgtctgggcatgtgagagctcagagccagagctttccttccatcagaaattgtttggtttgaacactgacaaaaacatagcatgaggatttgtagcacatggccaccaggccaccattttcttcaggatcattttagatatttttttttttttttttttttttgcagatgaagtctcttgctgtgttgcccaggctggagggcagtggcacgatcttaactcactgcaacctccaccttctgggttcaagcgattctcctgcctcagcctcccaagtagctgggattacaggtgtgcctcacaatgcccggctaatttttgtattttttgtagagacaaggtttcaccatgttggccaggctgatctcaaactcttgagctcaagtgatctgcccacctcggcttcccaaaatgctgggattataggcatcagccactacgcctggcacattttggatctttatatgtaaaagttgaagcaagaacttgggatgcctaaagaatgatgcctcccagcattagtaagggcagtgtttccaactgaactttgtacagaaaaacccaaacaaaactaaagatgtattttttaggtggtataaattcgaagtgctcaatgttcaagaatccacaataaagaagggcagggatgactgaatagtgataagaactagttgacattgtttagtcatagaacccaaacaaaatctattggttcttaacaacacataaattactccttaggactaatgtaaacagacaaatagaaaggtaacttcattttttaattatctaaatttttcacttttgtaaaagaatcatattataccataaaaatattaaccatgtctccaacttaaattcatgttaaatttccagtggtagctatgtaataaattattgctaagtagaattgtagactgaaagaattaatccatcttctataaatcctgaagattatgttaaccttttccagacacctaaacaagtatgttacatgattcagaaaaagtcatttttgacaagtataaaatgattttgaggtgtgatagcaaattagctgtttcaaacctatgttagagaaattaagttttcagagcaatttttttttgtatttgtgcttatattcctgaaacaacttgcttaaggagagtctccttaaatggaaacataaatggtatacaaatggctatcctctatcataatcttttatttccaaaactcagacaggtttttatcatcatgctctttggactcttaaccatcttcttctacttttaaattctacttctttctcaatacatttttaaacagcatcttgtgatcatttcccagtcttgagtgcctggcactgggaggtgacctgcccacattgctgtcagaattcgctgctggacccctgcacaggtcccaggctgttggttacgtgtttcaatctgcacatcagccatcctcaccagccttcctttgtgcatctggaaataaaaatgctcttgataaaatggttttctaaagtttccattaggttgctcttcatttcatttttcctttcttcttcccaagcctttgtggcttgcatagaattgaaaaaaaaaatgtaatttctccagggctaaaatccaagactttgataggcagtcttaatgcatggggctcctacgagttgctacccgttataagcattgtaaaactcaccctgcagaacaaagagaactgggcacaaagattattctcttcttcaaccatggcaagccctagttttccggtttcctttgccttttccttctttgatctctaaaagaaggtagaagagtagaacgctattgttcagaaaggagaaagctattgcttgtccaaacagattgttttttccttctgtttggcaacctcaatggctctacctgtttctggctgtcatacttcggcttgtgaacagccttcctccctaattttcaggaaactaacaaattaaaggtgcaaatgtcaggtggttactacatatctactggctcacataattcaaaacagagtcatgcagctcctatctaaagctagttccttgccccttctcagtcactaccacatcaagcacaaatgtagatgaaagggtagtgtgtcaaggtgagagctgcccactgggtagtgttactcggtcacttgctataggggacagattagctgccaatcagtatctcatcactgtcattggcgtttataatccaggttcctagccccactggtgatctatttctgtgcctccgcagtgacgccagttgtcctagcaacgtgctggctggcacttcgttaaaggcaagtaagggagtggtggtggaagagggtggcctcgagagggtcagaagggagttggcagtcaccttgctcaaagaggattttccatttccctcatctgggcaggcctccaggaggaaaacgtcacttactaagtgtatcatgggagtgtcacttactaaggatcatggaccacatggtctttctggtacagatagaatcccacggagaataacaaatgaattaatgggtagtccaggcagaatgtggggactgccgggccaagatgttaggcgatctcaaagcatctgatggtatcagtttttcttgtgaattaggttaatgttttgcttgtttatcagcactggcatgcagagttggagacatgagtagatgtttgggaggaatcagaggtcaagggaggcagaaggaagggaaacaccatgacagtccctcttggccccttttcctgttgacaggtctggcctgaaagccatccagtgtaacgagagccttcttactgagctctggtaatttatccatgcacccagccttgaagaggaatatggctcactttgtaatcttcttaattgctctcctctcattatgccacattgaattggcactaaatgactttttctgccattttccgatttggatccaaagaacatagaaatactgtggattgtatcttaaagtccctgtccaaagtggccttgcctagatgaaatctaaaatggacagtcaagtgacattggcagagctgggggcttccctccatggccacttctctgtggaagcccctaggcaatgggtttgggtgacattttctcctgagagtgcttcgtctgtgtggccctggagatgccaagacatttttcacgaagaaagagactcaaggtgggtctttgcaaggaaatggggaacaagggagactgatgaaagggtgtccccagagcattgaagacccacagatgacaggaagtatgacgtatgcattgttgcctttcccttcacgactaaaagagtttttgtagtctcaatgaccgttgtcatttgttccactgaatgaccacactcaagtcgagataattgcatgaaactgtgtgcttatgatgggaaagacatttagggtgtaactgaccatttctagcacgttttgtatactcaacagaaggtatattcactccttctaccatagctgaaataagggctggtagtgaagatctgggactggaattgaaagaaataatttttggaaaaagaaaaactccaagggtagctgttggcactttcagagcatcccatattttcaggatgttttgtatgagataaagtaaatcagttttgtttgacagggtgtagtgtgcccagccaggtcattattttaaattgacaaaatgatttaaatgatagaagacattgtatattcctgaaacaataaatacctattaagtacattttgatacagtggagaagtacagtttttgttttttgtttttttttttggattattatataactgttaattcaacacttagtgtttaaatactcatcattctttatagtgcacaggtcataaagatagttctctcatatgaataagaaatacaactaatgtgaatggcattaaagttagaagcttcaaattcttctctgggtttgatggttgcttttttagaagaaatttggtaaagtagatgatagaccagttaggtttcatgaacttcgtgcttcatattcttttcttttcacaacctagctagatacacagtaaataactggaagcatactagagtagaaagaacccttcttcctgaataagttgtcgttgatcacaggggtaggcgttaatcaaaatattaatgactaggccaggcacagtaattccagcactttgggaagccaaggcgggtggatcacctgaggtcaggagttcaagaccagcctggccaacatggtgaaaccttatctctactaaaaatatatataaaattagctgggcatggtggtgcatgcctgtagtcccagctactcgggaggctgaggcaggagaatcacttggacccgggaggtggaggttgcagtgagccaagatcatgccactgcactccagtctgggtaacagagtgagactccatctcaaaaaaaaaaaaaaaagtaatgactaaggagaagatagggacaccttgggctctgtccagtagcaggaacctcaggctaagaagggacacctgggttctcttcccatccctgcccttttagaccagtggcaagctactctctatctgggtgcctctatttccttatcttccaaaggaagatcattatcactgccacttaacagcatcagatttaaagtattagttcatataagagactctttgaatcacatttgggttcagatttcagacctgccacccagtagctgtgtgtcctttgggaaattgcccaacttctctgagccttatttacttcatctataaagaaggtctgaccacacctaccctgatgacctgttaagagagttaaatgcgataaagtctgttaagtttttagcccagtgattgctccctaataactgtggcagccatgatgctgttatgataaatttcacacaacaaaatctatcatgatgcgttgctgaagtgaacaggtgagcagttgcaacttgctcatctctttgttgtagagacatttctgctataataggagttgtcattaactgtcattgtcattacactgacagtgaattcggttatgtattgttaagaccttctgcttccttgacatgtatatagtagaataattatgacagtgaaggtgacacatttgtcagaattatccatgtgcatatgctgagggcccttggaattttaggtgaattttatagtattagtcaaactgaaaggcacagtgagtttggaaactataatagtctcatctataaaaggagtagggagattcccaaaggctgttgatatgagtagaactctgaaaaagtaaaacattaaaatacattttgatgtggttaccgtgtctaggtggtgataggtaaaaacagtctagtctaattctttgaaatttaggatagaagaaagcctgaagatggatatctacattcttgtatcttctttcagcaaatatttacagaaagagagagagagtgtgtgtgtgtgtgtgtgtgtgtgtgtgtatgcacacacatatgctacaggctaggcacctacagtagttaaaggagctttcagtcactggggaaagaaatgagaaaacaggcaattcctttacaccatgaccagctctctcctaatggtacccacaggttgccatggatgcagaccagcatggcatcttctgggatcagggaagctttcatcctcagacttgaatgaggagtagatgttaaccagaaaacaaagtggatgtatcagttagcatatactgtgtaacaagccatcccaacagttaagggccaagaccacaatcttatgattgtgggtcacctggactattttagtctgggccagcttggctgggactggttaatccagcatggtctcactcacatagctactagaaggctggtttgcctgagagatgggtgatcttcagctgggacagcttgtctctgcttcaggtggcctctcatcctccagtagactagtctgagcttcttcactttgcaggctaagggttcccaaaagcagcaagaaagggcaagccccagtgcatgagtgcttttcaagctctgcttcaagatgcttgctaatttccctttaaccaaagcaaattacttaatttgttcagttcaaaggatggggaaactccagctctagtcacatgaggacaacatgagcaaagctcaaaggtaagagagaacatggcatgttggaagacagcaagtagtttggagtggctggagtcaggcatatgtgaagtctcatgaagaaaaagccagatcataaagtgtcttttcagtaagttctgctgaggagtttagagtttatcttgaagacaggggagtggtcattgaaagagtttaagcaggatgttgacatgatcaatgagatgtgtagagacatggttaggtggtagaagcctaaaaacactcgttagcctagacaattcaggaagtttccaaagagatgacccagggatagcataggagaagatggaaggacttgactgagaggtggctcaaagctgacgtgtactttcagaacaatgtgaccagaaaagaggttggaggcccttcaaggtagagcagaaaagacagaggctcaggtcatcagcaatatccgtatgaatctggtgggagaactccaccagtgttcctcacctcgctcctttgtgggatcctgccagactccaatgtccttgggttctaaataaacacctaccaaggggctgagtcaaagagattccagtctctggaagtgtcttcttgtcattgtcatcacccagccaaagactcttttccttccaacatgtttttccctttgacctcaaaataaacaatgtgttctaaaggctctggggcactctcaaaatgcttctctgacctcggataggaccatgcttacccattaatttccagatctgaccttttcactacacctttaagcataactctttcaaaaggcaaaaatagaaatgactgtttcatttcaccaaattcaagtcgccaagagtgagaacgtgtggttttcaccggtacgtttggggaccagtttgttgtcactgaaactgcctgatatcgggtcggagtggctgggtatttttcagtccttggggttataactcaaatgttggaagtggtatcttttataggtaaaattgagggaggggagcatcaaaatgtgtgcgatgcagataataatttgccaagttttctaatttttttcattaaaaaagaacatacagaagagtctacaagtagggcaggcagccttcattcctatgctcttttccttgagggacaccttccctaaccaaataattgaaaataaatgggaattgtgggaacagaggaagacaagaaggaaaactaaaaacccaggacctaatcttccaggggcaggcaggccacttttgtagctcagattctgaccttttctccaatcaaagagttcgaacagactgactgattggagtgctctgtcagcattaaactcaatgcagggttctgctctggcacctttaggggtggtggtttagaccctctgcgtgccatgtcttatcaccagcactgctaactgaatgggatgcattttcaaagacaggagagggtttgaaaaaccccagggcatgctcggagcctgcaggcatttgtttgctgctgagaaccatggcaagcatttttgacatttttatcagagtcttagttaaacaattatgtggaggactgataaagaagtgtgtgataggagacttcataatttaaagtgcccaaatttggtgagctttatactcatgtgaaatggaaatgaaaacatggcatgttttggaattcctgattctgcttatttgctttaatagcagatcattgcataaacactgactcattgcattctatactgaaaggaagatatggtttgctgtgttcaatctggtctggcttccagaacacagtatagaacaagtgccagaagaagggatgagctcagctttataggtgactggagagatacccaattccatgttttgtgctgtacaaacacatgaccttacatgaagttttgcataaaatattgaaacaatacatttctctttataaatatgtatgtaatctgttctagagtgtatggagtagacagtaaaaaaaaatagaatcttcttatttttggaagtggggtgaagacgcaggtgtgcatatgctgccacctgcgtgttatttcactgagttttgtcaggttcttttcttactcatctgcactttgtatgttaccttaagcgctgtaaccattctaagctgccagggacatgggtatgcaatcaaagtcaacactgtgattaaaaccacctcctgttgtttacctttttagaaattttaataatacagtcaagtctgaaagagcagaacttttctcaaagctacacacttggttgcctcttcttgattaatgcatgggggtggtcactgtaacctaaggtctgacagatggtgcggagattgatgaagttaaggcctgttaggtattccgagtgtcttataaagaaaaataggctaccttaattcaaattgttgttgctcttccaaccttctcttatgtaaactccctgtatattacaatgacagactctctctctttctgtctcacacacacacacacacacacacgcatgcatgcacacatacgcacactcctgacatgctctactgaaagctgcccagctacagagaggtgcgaatctaatccagggcacatggctgctttgcatttcactggctgtctagtgtcactctatgatataggcataaggtcatgactgtgagctatcattgtcacttatcttaatattaaaacccctctgatccaatctgtctgccttatctattacatcattcacatatctagattcttcaaacttaactactcattgcagcaaactcaggaatgccgagctctaaggcatctccatttacttcgttcatctcaatctcaaattactaaccatagttcagtttcaggatgacactgaaaattcaaaattacttcctgtgattaacttacattgtgatggttgggaattatttcgcagaagacctgttcatcttctgatgaagcccttttcaagttttgaattgtgtgtgtgtgtgtgtgtgtgtgtgtgtgttttaattgccagaagtctttcagatagcagggagattattggaatgagaaagcaaagcttgtatgaaaacttgtggcaaaaggtcatctgtgctgtgggggaaatttcaaagtaggcgcagtttgtttccagtggttcctgcctgtcctttcagtggctggtcactctctgttccctttccagacgaatctttcccctcttccaaatgcctcacatcagtctaggtaccttggttggcctgtggagaaaaacagtcttgttgagacactcacattaagctgatagagaccttggctaggataattgcatttttcaaaggctaagggttggaaggatttaatttttctcttaattattttttatagagatgaagtctcactatgttgcccaggctggactcacactccctggcctcaagtgatcctcctgtcttgacctcccaaagtgctgaaattacaagcatggcctgaatttttttaatggtgatttcagctgatcccaggggagatcttttgggtgtcatttttcaaacagattaggaagcaagcagctgtctacctaatcagtctaaactacccattctgacttctgtccaataactttccatataaaatagctaacataataataatcagataactttgcatgtaagtttcaaagctatggtatagttcaccaacataattttccagttttttttattatagtaaagtacacataacataaaatttactgtcttagccatttttaagtgtatagttgtacattcatattgatgtgaagccatctccattgtcttgtcttcacacctctttttttctggcaaaactgaatctagacccataaaatactaatgctctaccctccaccctagcccccggcagccaccattctacttgctgtctattattttgactactgtaagtggctcatataagtggaatcatgtagtatttgtccttttgtgcctggctcatttcactgagcataatgtccttcaggtctgtctgtgctatagcatgtcagaatttccttcctttttagactgaataatattctgttgtatgtgtagaccacatttagcttatccttcatctatcagtgggcacttgggttgcttccacctttagtttattgttaataatgctgctatggatatgagtgtgcaaatatctctttgaaactctttgaaaccattcatcaactctctctttttcttttttttttttttgagacagagttttgctcttgttgcccaggctggagtgcagtggtgtgatctcggctcaaaacctctgcctcccaggttcaagcaattctgttgcctcagcctcccaagtagctgggattacaggtgcccgccaccacaccaggctaattttgtatttttagtagggtcagggttttgccatgttggtcaggctggtctcaaattcctgacctcaggtgatctgcctgcctcggcctcccaaagcactgggattacaggcatgagccaccgcacccagtcttcaccaactctctttcacgtctttattagatacaagtgtttgaagaagccttgcatctacccactttgaaccttttttcatgatagaactgtaggtagactttctgcctagtagtgttatttgaagcatcctttctgctgacctctttcctgaggcctgaaatgctactaatagtagttcagtcctcaagtatcaagcaaagccatcagctagttttctattaaaatgcaaatgatcctggggcagaggccacagataagatattagcaccttggtgtgaatttgtttaattagatcctatcttagaagctttctttaaccccttgcctagttcttcactaattgctccctgataaggtcttgcattattactgcaagtatcacactgtattaaacttatttatatttttgcttctcctgatagaatagaagcttcttaagggcaagactcttgtataattgctgttggtttttcaggccctaatagaatgtcacagacaactttcaataagctactcactcattctttcatgcattcattcattcatttcactcatttattcatcaagcatttattgggtgcccacggtgtaagtgcattttaaaactctgcctttctagaaggtttggacagccaagggccagctctgttgcacagttttggcagattttagaaaccttaaaatctaacttcctgtatttttaggtgcagggacttggtccagatgagtggatcaacctctgaaatagttttctatcacagtcctaccttttttttttttctgcttctattcagaagaagcatcgatctaagtaagtttgtgttctgttcaaaagtaaggtgatgtttcaatgtatattctcaagcatctgaaaacttctctagttgctctaaatctcaatatttccaatatcagccatgtacagtttttaaatgcttgcattctcttaggacattgttaacaatctgcttagaaaggggagtgacttttgcctcttttggctaatttgctttgcattgatttgtaactgtgtacttcagtatataccagcaactcctagcccagggatagcatatactcgcttactggttccagtgactgttcattcatcccacagtggcttccctggaaacaagttactctgataacaatttgatggtacttccctttataaggtaataaccagtccgggccaggcatggtggctcacgcctgtaatcccagcactttaggaggccgaggcgggcagatcacgatgtcaggaaatcaagaccatcctgactaacacagtgaaaccccgtctctactaaaaatacaaaaaccaaattagccacgcgtggtggcatgcgcctgtagtcccagctactcaggaggctgaggcgggagaatggcgtgaacctgggaagtggagcttgcagtgagccaagatcgtgccactgcactccagcctgggcgacagagtgagactccgtctcaaaataaaataaaataaaaataaaaataataataaaaaccagtcctaaaccaaattcttactttagtctctagcctcagagtttattagttcttagtaatgttactatgaaggcaaataggagacaaattattattctggtttttattgttactgccactgcaattcctatgattattgctataattccctatttaataggtaaacaagttacaacatattcgatggtcactagatagaaatagaaatggaatgtctttaccaagagaatatccgtgttttacagagaacaggaaacaagtactaaatggaatcttcagacaatcttttggtcttcttgtaggcagtggttcagcttttttacctactaaaattttggacagggttgttaacaggcaatacagtttaaaatgaactgttttaagttttcctttctgactttttcatactcctacattaatgcaataggattgaaggctacaacaatgataattgcaatatgctgaaataatgaactacagtaaatagctatagtgaatgtatgcccatagaaaagaatggaaaacaaatggcttttgattaaaggtacttattgtaacagatttcaaggtgaaattgttagttcagaaaagatggtagatagagtctttaaaaatactgtcactgggatgcgtgttcttctataatgctccctccatcccccacccgaagaaacacacactcctccctcctctgcatgtaaagcagtagttttgacaaataaaaccaaacagtaaaacctgacactggtgattggaccgtgcgtccctctggtttgtggatgaggagcatatctccgtgatagaataaccacgcttcatgctaactcccggccacatcgctgcatcctcttcatacataatttgcatcatggggtgtttctgcatatgttgtgcattttgatgttatttttagctacaatttttaaaacaataacatttttttaaatagactaatcaagaaagcgcctccagagtcaagaaaacaagtgctggggatgtgtgggtgggggtctgtctccccgcccagggcatttccctttgctgctgttgttactactccttccattactttttgtgactttagctttttgaaatttccattcctttgttttcccttgtgcatcaggatgtggctgttgaagtcatttatgttatgcgaggctgcaccacagtcatttaatgcaaacactggcttttgtgtaaggcactgactattctaccctcagcgaggaagacgttattggaaacttgagttatgagatggaaagaacattaatcctttcattgaaaacattagtcttttacatggattctctgtaatagcttgaagagaaattaaggaaatacaaactagtaatattaaaaatctgccatgtcattattatctacctgcccatagatgttcaccaccgttagcatttgagtgtgttttcttccagaagattttctatggatatatatatatacaaataaatacatgtagctttacagaaatagaatcgtgcttgatctacttttccgaaatttcttctctcacattgcaaaagttgtgaatgtctttccatctgaattattacagattttcaaaatatttttctggctactgacttttccagtatatgaatgtaagagtgaaagttcttcgatttcaccagttggatatgcccccttttctcttttctgccaatatcaattgtactgccctcttgcgctatcctaaatatgatcagatgagaattctgaaagagaagaaatctaggaaccctacttgatagagagttatcctcttgggttccctcctgacatttaggcctttttttttttttttttttttttttttttttttgagatggggtctgactctgtcacccagactggagtgcagtggcgcaatctcggctcactgcaatctctgcccccgcctgggtacaagcgattctcctgcctcagcctccctagtagctgggattacaggcacctgccactgcgcccagctaatttttgtatttttagtagagatggggtttcactgtgttagccaggatgttctcgatctcctgaccttgtggtccacccgccttggcctcccaaagtgctgggattacaggcatgagccaccgcgcctggccacatttagtacttttaagaagttattcctcttccatctcagcttcctggacacagttcgctatgacttttcttggaaattatgcattcccttagaatccttgtattttctgtttactttccctcaaagcaaggactcatgacctcacctgtagtgggcctccccatctctcatgtctttatgtggcccggacttagcagagacacctcttggtacatcattttgattgcatcatgagctttcccagagtctggagtgactctgtctttcagatttcattttaacctcctaatcacaggctatctttgatgcacctatctttacctccagttcttctgctaaagaactggaggcttgtggctcttgtcttccggtcaaacatgatgctctgctgactactcttccccatgcattcatcccaccccagaccctgcccttgccctcatccccatctgaatcattgcatcctcctagttcttggccaaaaaactggctctcctctagcccttcaaaccttgcctgggagtcatctttatggcaccttccctgattttttgttttgttttgttttgtttttggaaatggaatttcactcttgtcacccaggctggagtgcagtggcacgatcttggctcacggcaacctccgtctcctgggttcaagcaattctcctgcctcagcctcccaagtagctgggactacagacacctgccaccatgcccagctaatttttctatttttagtagagacggggtttcaccatgttggccaggctggtctcctgccctttggtgatcaacctgccttggcctcccaaagtgctgggattacaggcatcagctaccacacccagccgttgcaccttgcctgattaattccacttggctctagctagtatctggaaggacacctgggaggaacacttcaaacagctgtcagtgcagtgttgttgttgtttttgttttttaattaataggcttttttatagaacagttttaggtttacagaaaaattgatttgaaagtacaaagagttcctatattcctagcctccccgacccctgacaaacagtgtccctactgctaacatcttgcatcttacatttgttgaaattgaactaatatggatacattattattaactaaagtctatagttcatgttagagttcattcttcctgttgtacattctgtgtttgacaaatagatgacatgtgtcctaacaactctttgtgctctgcttatttgttcctcccaatccccaaaacccctgatttttttttttttttttactatccctgtagctttgccttttccaaaatgtcataaagttggaatcatacagtatgtacccttttcacattggcttctttcatgtggcaatatgcgtgtaagtttcctctatgtctttttgtgtctggagttggttcctaccggtgggtttatggtctcgctgacttcaagaatggagctgcggaccttcatggtgagtgttacagctcttaaagatggcatggacccaaagagtgagcagtagcaaggtttattgtgaagagcaaaaggacaaagcttccacagcgtggaaggggacccaagtgggttgctgctgctggctgtggtggccagcttttattcccttatttgtccctgcccatgttccatttctgttctgtcagagtgccctttttttcaatcctccctgcgattggctacctttagaatcctgctgattgatgcattttacagagcactaattggtgcgttttacagagcacttattggtgcattttacaaagtgctgattggtgcattttacgaacctcttgtaagacaggaaagttcctgattggtgcattttacatcctcttgtaagacaggaaagttcctcaagtccctacttgacccaggaagtccagctggcctcacctctcaatcccccctctaaacaggacaccccagctgctgttgggaactgggtgatgactgctctagctacttcctgctggataggggtgaagaaggggccctgcagttgtagtgccctccagaggggaacactctaggccaaagggctggtgggtcagtccaggggtccttggtagaagttgtgagttgagctcatttggggttccatttgtaagaccatctgtagcttgatggtatcgatcctggaggaaacaaatttgacaaagaggttaaaaacacagggcccgaaggtgagtaatagcaagatggctgtcatgggacgtagaaaggggagaaaccatgttgcccaactctagaggttggtataagagtttgaaaggcattgtctgatttcagaagccttttcctgtaactgctgggcagcatcttgtactatccctgagtggttagtgtaaaaacaacagtcttctcctaagaaggtgcagagtcttcctttctcagcagtgaggaggtctaggccttggcggttttggatattcactactgccaaagagtctatttgggattgcagagtaaggatagattttgttatttcttgcaaactgtcttgagaaatcctttgagagtgtgtggtagtaggataatgaagtagataaactggctattctggttcctgtagcagtggctattcttaaccgtataagtaggggtattagttgtatggccctgtactgacggacctgagctttgaggggcactgatagggtctgatttcctgcggtaatgttaatgttgggacttaggaagactaaggtacaggtgcctgtccagttagtggggaggcagatgtaagttgaagttccacataagaatatgccttggctgggtagacagaactggttgtgtatgttaaaaaggtgtgtgagtttgttgttttcattttcccatactcctagagtacttgccaaggtagtctggtgagtggctggaaaggggtgttgggagcaaactgagtgactccctgtgctctattttcccattggagaaaaaactgttttgtatctactaggaaccattcaagagagtgattgaaagagaggatgagaaggtattccttagtggtgggggtgctgctgcagggggtccaggggtgaatagtcatacagggagtatgtttgccattacaaaacctggactgtttgttaagcagggaggaggtgatgatttttgggggccctgagaagcggacaagccatctgaatagagcggtttgggtgccttggaagttactatgatcatttggggcttgaagttggagagtgtaattacactgatgggatagtaggtgccccaggggcaggcctgataacaggttgcgttggatgcataacggggcttggaaagttaagatggtattcacggttacagggcttttcattgctcatgtaataggtgaggttggaaatgtaagagcgtaaaagctggattgcatgtaaaaaaggttgatgtgattaggatttttgtcccggcaggagctacagtatatagtcctgctgcaaagagaatggttagtatactgcttaataatgtgatgaaactgtaaaaggattccattaaaggggcaaggagtggtgttaaagattatgtaggttttcacttatcctttttaaataggaaagagtttttccttaggatcagctataggggcctttttagtctgggatgtttccttctgaaataggagacacaaatcttccaatggttcacaggtttatcgaggctggtctggctgatcttgggactcctgagctgatggtcctacaggttcttcagggggtgtccaaagtttaactcgcatgtagtgaatccaagattccactcctgccaccttaactgcagtgggggtagagaggattactgagtatggtccttcccacaaggaatccatagatgaggaggaagaggggagggacttgaccaacagtaaatctcctggttggaacaactctgttcccttgtctctgtgacatcctttgggtaggtttttaacgttttgttggtattttgccaaagaagttatatctttgaccaacttggccgtttcctgatcaagtaggaggtcatttgtgagaaaaggtcatccatacagcacttcatatggactgagccccattttgtgaggagaattttggattctcaacaaggccatgggcaagagagtaggccatgggagatgagtttcttgtgttcgtttccttaagtgcctcttgagtgtttcgtttgccttctcagccttccctgaggattgtggcctccaggcacagtgaaagtgatattgtatccctagtgccctggaaattccctgagttaccgtggctttaagagccggaccattgtcgttttgtaagctttggggaagcccaaatctgggaattatttcatgagttagtactttaaccacttcctgagccttctccgtcttgcaggggaaggcttctatccaatttggttggtcaacacagaccaacaagtattgaaatccccttgacttaggcatatgggtgaagtctaactgccagtcctctccaggatagtgacctattctttgttccccaaaaggggccttacgatggaccaagagatttttcctttggcacacctcacaggctttgactacttgttggatggtctggaggagatatggccccataaatagggatttggccatttgatgagtgttctcaaacccatgtgaaaagtttggcagggggtcttaagtattttccactggctggcttcggatatgagtacctttccctcttctgccgttaaccaccccaaggggagaaaactatgcccccgtgaaagtccccattctgtttcgatcagggagtactggggcttaatctcttggagggggttgttccataccatgggtccttccataggtatttctaatgggaggttctgcctggcagcaattttggcctcagcatctgcccagtggtttccttctgccttttctccttcacctttttgatggcttcagcagtgtaacactgccacctccttgggtttttgcactgtgtgcaataactccataatttccttgtggtatttaatgggggttcccccagaggttaggaactccctttctttccatattgcagcatgggcatgtaggattagataagcatacttgctatctgtatacacatttattcttttttcctttcccggttctaaggcttgggtaagttctgctaactaggcgctggtccgtggggggaagagacttactttcaagtactgttacatcactaactatggcataacctgcccttcatatcccattctccacaaatgaacttccatcggtatataggttaaggtcaggattagctaagggtacttctaagagatcctgttgggaagcataagtctgggctacaatttgttggcagtcatactcgattggttctccatcctctgggagaaaagtagcagggttgagggctgcacacgtgtgtatttcaagcaccagtccctgaatgagtagcgcctggtacctgagtaggtggttttctgatagccataaatttcctttggcacctggtatgccatttacatcatgagtagtctagatggtgagatcctttccttgtattattttgatagcctctgacactaagatagccactgccacaactacccgtaaacagtgaggccagccttttgctactacatcaatttccttacttaggttgtggggttccttccttactggttgtggggttgtcctacaagtctgagtaaggactccaagagctattcccgctctctctgtgaggtataaagagaagttttgtcctggggaaggcttaagtcttgagtttgtactagggcctgctttaaggttttgaaggctgtttctgcctctggttcccattctactagatgaatatttgccctctcggtctccttgattagagtatagagtggcctggccatctcgctgtatccggggatccatagtcggtaaaagccagtgatcccaaggaacccccacaactgttttaatgtgttagggcaaggacaagccagtataggctgtatttgttctttgctgagggccctggttcctctggctaggattaggcttagatatttgacttgttgtaggcagagctgggccttcgatttagatgccttgtacccttgattagctagaaagttcaagagatctagagtagcctgctggcatgaagcttccgaactggtagccaaaagtaaatcatccacatactgaaggaccagcatgcctggacttgagaagtggcctagatcttgggacagtgcctgaccaaacagatgagggctatccctaaacccttgaggcaagaccgtccatgtaagttgggttttgtggtctgtgggatcctcaaaggcaaagagaaactgggagtccaagtgcagaggaacgcagaaggcagcatccttgaggtccagaacagtgaaaccattctgcttcctttggtatttgagagagcagggtataggggttgggtacaaccggatatagaggaattacttcctcactgatgagtctaggatcttgcactagtctccactgacgattcagtttttgtactcctagaattggggtgttgcaggggctactgcattttcttactaagcctcgaacttttaaatgtataacaatatcctgtaatcctttatgagcttcaggccttaagagatattgcctttgataaggaaaagtggtggggtcttatagcctgatttggactgggtgggcattttttgcctttccgaattgtccttccaatgcccagacttcagggttgattccctcctcaagtaggggacaacaaatgggtaacttgttccccatattcatatagttaatggctccagctttggctaatatgtccctccctaataagggtgtggggctttcaggcataagaaaagcatgtgaaaagagcaaagtctcccaattacaactgaggaggtgggagaaatacctggttacaggctgtcccaggattccttggatggtaatggatcttgaggacagctgtctggggcaggagattaacactgagaaggccatgccagtgtccaggaggaagtcaatttcctggccctcaatggctaaacttgcccagggctcagtgagggtgatgacatgagctggtgcttgcaccaggcaccctcagtcctgttgttggatcatctggttgggggcttctggcccggagaacctttgtcctctggggcagtaccccgtctagtgattgccttggcatagtggacatgggtgagggagtagcttgtttcttgttggacagtcttttttaaggtgtccttgcaaaccacactgataacaagccctactgggtgattggcctgctccattttctgtcctctctgaaccaccaaggtttgtttgtctgagggccatgactgaggctgcggcctttctcttatctcgcttttccttttctgcctgttcctcttggttcctattagagaacaccgcggttgccaggtttaataatgcctccagattttgttcagggccaagggctcgcttttggagctttctcctgatatctcagctgattgggtaataaacatcttttaggatcaattgaccctcgagggagttgggtgacaggggagtatattttcttaaggcctcccatagctgcttgaggaaggcagtaggattttcttcctttccctgagttatggtggacatcattgaataattcatgggctttttcctaattctccttagtccttctggaatacaggtcaacagatgtttgcgactccagttcccatgatctgagtctaggtcccagtggggatccataatggggatggcttgctgcccattagggaatttgtccctttcttcggctgtcattttgtcatttacttgactaagataccaggtatctccaaattctcgggctgcagctaaagctgcattcttttcattaaaggccagggtttgatctaacaatagcatgacatctctccaagtgaggtcgaaggtttgccctggaccctgtaggacatctatatacctaccaggatcatctgaaaactttcccaggtctaccttgatctgctttaattcagagagagagaaggtcccatgttgggccaaattcccctccccctacagcttaaaggagacataactgatagcctgaggggtttggtggtcctttggaaatttctttgcttgtttccttctggatggaggagattagaggaggctcatcattaataggaaggggagctgtagggaggctaggatatggaggtaatctgagaggtcctcctgtggaatgtaaatcgccagctttgcatagttgtggattatccttcagtaaaaagaaagcttggacataaggtatttcactccatttcccttccctcttacagaaaaggtcaacctgcagaatagtgttgtaatttatacttccctcaggtgaccatttttccctattagagagataatattaaggccagaccgtagtgcagaaaaaataagccgcttctttttcagggtttgcgggacaaattggtcccaatggcttaggatgcgtttcaagggtgagcttgttgatgcctgggtgtttcccatctgaaagaaaaaaccgcctgcagttttttttttttttctcttctccctgcccaagaacccacaacagtccctggatcctgctgttcggaatagctgtgctcaccaaagcagcagcggaaacactagttttcctcctagaccacaaaaaggactgaggaaggtcagatttagtggcccttaccaatggattctcaaaaacctgcacccttgcctttcgtctttagaccacaaagaggactgagaaaagtcagatttagtggcccttaccaatgcattcttgaaaacctgttagagtcctaagtgttttctcctgttgttattaggaccttacccttgtactataaagataatatgcctcaaaatggagtggagggccataccctgagggaaggaagggatctccagggttggaagagtgatgcgttttgtcctcacttatcatatgaataggaaggatataatttctgagtctcctcctatcctagctttgggaatagcctttgttaggtctgctagtctgaggagggatcctaaaattccagatagtcccccacaacagggctttggacaaaaattatgtctttctgattggtgagcctgggtgcctaaagaagggagcagagtcctgaaatttatattagaaatcatccttataggagaaactggaagagcaccagggacagggagtggtttttagaagcaagactaaccttggagaagagaggcgggagaaagtttgtctgacaggtgttaggacccaggaggcaagggtcaggatagataggatagatgggtgagtcttgtttgggctatgtaactttgagagttctgctcatggctgcagggccaaccaactttttgttgagaccccggagctgaatggctttcctctctgtcgaccctaggcttagcccggaagtgcaggaaaagcagaagctggttccaggcaaaccaatgctcctgactccaaacagtcgggggttgttagtgagccctttcccagagagcctgacatccatgtccttagtcctgtggccatgctagttgcttttaactggctgacaggtgcctagttttagcccctgaattctaaggaaaaataggacagaatagcaagcaaaaggggtctgatggtactcaccacgttgcaatatctgggaggatcccccaagatgtgtccagagttggttccagccggtggattcatggtctcgctgacttcaagaatggaggcacggaccttcacggtgagtgttacagctcttaaagatggcacagacccaaagagtgagcagtagcaaggttaactgtgaagagcgacaggacaaagcttccccagcgtggaaggggacccaaatgggttgccactgctggctggggtggcccgcttttattcccttatttgtcccctcccatattctgtttctgtcctatcagagtgccatttttttcaatcctccctgcgattggctacttttatactcctgctgattggtgcattttacagagcgttgattggtgcattttacagagcgttgattggtgcattttaccaagtgctgattggtgcgctttacaaacctcttataagacaggaaagttcctgattggtgtgttttacaatccttttgtaggacgggaaatttccccaagtccccactcaacccaggaagtccagctggcttcacctctcatttttatggcctgaaagcttatttgtttttagtgctgaataatattctattgtatggatgtaccacagttcatgtacccattcacgattatgaatgaagctgctataaacatttgagtgcaggtttttgtgtggacttaagtttttagtttatttgtgtagataccaaggagcatgcttgccacattgcatgttaagagtatgtttagctttgtaggaaactgccaaactgttttcccaagtagcttactatttgcattcccacccgcaatgacttgagagttcctatggctctgcatccttgccagcatctgctgttggcagtgtgttggattttggccattttcataggtggtatcttgtgtttgttttaattcacagttccctagtgattcataatgtggagcatctttttatgtgcttacttgccatctctatgtctaatttggtaaggtgtctggtcaggtcttttgtccattttaaaaactgggttgtttgttttctaatagtgaagttttctacagctctgttgtgtggttacttcttttttacatcaagatgagtcttactacctggttagattgggtgttacttgtagagatgctctccttccttccttctgtctcctagagcatttgccacacttcagatcctcagtaaatacagtcttcccaacccaatgcctgccacatgtttcctgacctcaagttcatatatcctctcgcattccctttactcctttccatacataacagtggtggtcactgctgagtccccctgaaggtgagcttatctacctctttttatatccaagctgcttaattgctataatatccaagctcccagatcacagcttttagttctttttctgaatctgaactggtgataagattaagaaatctcttggttcttttgcattaatttcttggttttgctgtctactataataatttaatagcatattttaaaaatgtttctgatggctgtttagttttgtctgctgactacaaaggttgttttgacctcatcttgctgacctgccaaaagcactaagtctatggcagtaagagagtggaaagtctgttccagtctctgtataatacaattacatgtactgtgtagcaataataattaacatgggaggaaatcagtacaaattagggatattcctgaatcattggctacactgtagataatgcagcttctcaagccagtttgttacaaatgggctacaggtatatccaagtatggattgcctcagccctcaggcagccttgacccctgaggctacagagcccctagcagggggggttaaccatttatgcaattatgctgctgcccagatgttattttctatacaagtagttcctttagagagagcaagtgcaagccccaagcactggcacaatatggagtggggaaaacaatgattttgaattcagaagaattcagttcctggtcagctctctgatggcagggattttgtctgctcagctcactgctctatccctgtacctaaatcagtacttggcacactgtaagcactcagtaaatatttatcgatctaattcttctgtttttttttttttttttttttttttttttgagacagagtctcgctcttattgcccaggctggagtccagccatctcagctcactgcaacctccacttcctgggttcaagcgattgtctgagtagctggaattacaggcacgtgccaccatgcctggctaaccttttttgtagttttagtagagacggggttttgccatgttggccaggctggtcttgaactcctgacctcaagtgatccgcctgactcagcctcccaaagtgctgggattacaagtgtgagccatctcgcccagcttcgatttaattattgaagcatacttgaattcaagcatgttacttaatcctctctgcacctcattttccagaattagaaatatagtttattcctatacagcagatataaatttatgtgtagacagttgggctgttgttgtaacctaaaagtgacatatgcacaacctgtagcacaatgccaggtacagagtaggggatccagtgggttctttcttaccctctttcatttgaagtttttaaagtatcaggtgaagatgatgatgatgatgataatgataatgaaagtgatattttttgcatacatttcagtaaagttcattaccttacactgatgtaatcctcagagcaattcttagacaattatggttttttaccccctctttattttattttatttttgagacggagtctcactctgtcgcccaggctggagtgcagtggcgcaatcttggctcacttcaacctctgcctcccgggttcaagcgattctcctgcctcagcctcctgagtagctgggactacaggcacctgccactacgcccagctaatttttttgtatttttagtagagacggggtttcaccgtgttagccaggatggtctcgatctcctgaccttgtgatccacccgcctcggcatcccaaagtgctgagagtgtaccccctctatcaatgatgagactgatgctgagaaaagtaacatgattatgtaagattacacaagtgaaacacaccaaaaacagaccttgaacccagtttttttattttctcacgtcaacttttcctccacaccaaatctaataaaattttataaagaattactttaaagactaaatcactttcgactagcatgttgtctggatgcaaatgatggtgataaagtaagtttaataatgcttaaaggaggtaaacaattcctaaaccttttaaaaaatctagtcagctaaagtaggtttacgctaaactttcatcagaatccttaaattctaaatcttgaacttttaaatcagtaatagagttttaatgtgaattaattgtctgtaacattttcaaaagataaaagtgataaatgcacaaacctacctgctattataaaacttgttgtggtggaatgagacaagaatagatgtactataagaacaagagggatatgaagaggcaggtttatgtcgatacttaaaatacatttgacgccatccttttgacaggaaggaatgtctttaaaatctcacaccagtgagagtgggaaaaaaatcagccatatttctgctttttttaccctttcattggaatgctcagtcacttggtctactctggttttgattcacaaatgagttttcagaaatgactgtcccactggctttttaaaagaaaaattcagtttttcctctgaagactgacacacaatcactcagagatggataatcctaaatgttttccttttccagctgaatttaatcttatgctatcaacaaaatctggaaaggtttactttctcatatcattcattactagttatgaattctgaaccgtatttgtaacctgttcatcacatattcatccctgcatgtattcattccctaaatatttattgaatgccagcaatacaccctgaactcggagaaaacataatctttaccctcaaaaagctcacagtctggtgctcagttgaccaaacatcgtgtttcttttctaccgagttgcaggtcttctctctgtggatgtcattgaatgtcgtttgcagaattctacttgctatagtaggcatctgtcttgttcatgagccacattacaacctcgtgtgttataggcaaaaaggcaatctaagaacggcctgacattcggacgcctaaggggacttccctagtgagggcacaagacagacaaatcccagaatattttctatatgcagaggaaacttctctggcatcttagaaagacaaagacagcaagactgaagatagaaacaggaggatagcaaccttttaaacaacttgtttttgtgaaatttgtttctgtttgctttgagaatgggggaaaagagaactctaattacaaactccacgtttctttcaactatactattttctttctttttttttttttgagacggagttttgctcttgttgcccacgctggagagcaatggcacgatcttggctcactgcaacctccgcctcctgggttcaagtggttctcctgcctcagccttctgagtagctgggattacaggcatgtgccaccacgcccggctaattttacatttttagcagagatgaggttcctccatgttggtcgggctggtctccaactcccgacctcaggtgatctgccggccttggcctcccaaagtgctgggattacaggcatgaggcactgcacctggcctttttttttgagacggagtctcgctctgtcgcccaggctggagtgcagtggtgtgatcttggctcactgcaaactctggccctcgggttcaagtgattcttctgcctcagcctcctgagtagctaactaatttttgtattttcagtagagactaatttttgtatttttagtagagacagtgtttcactgtgttggccaggcttgtctcgaattcctgacctttggtgatccacccacctgggcatcccaaagttctgggattacaggcgtgagcaactgtgcccaaccagttatactattttcaatcctatataatttgtacagctgaagtggcaactgcttgcttttaaatgggaagagaagatgtccccatttaatgcttagaaaagattgacttcggtttaagccaaaggagcatcctggagaaccgaatgattcatgattagtaattctcaaggaatggccatgtggctcttcatagcgttggcccttgggggggtctactttaatctttgttctaacccccgccgcccctgttgtccttttaatcctcatggatcaggtgcgttcacagataaccactaaagtgaggctgaaagaggttaggatggggatggacacctgtatttctgagaggacctctccatgatgtttaggaatggggttgacatccttcacctagaaggtcctttcccaagattggacattgattttggtcgctggagcagcctcatcagcatttctacaaggtccccagaagggaggaagctattcattgaatacttcatatggaggtggttttatgttatttttatgagatattaaggaatcttcagaaactcatagcatctccatgttgcagataaaagaggctcgatggaatgggagtgagtcagttcagagttactctgctaataataaacgtgctggctttgaacctacgtctctctgagtaataagcccctgccctctcttccaaagcacattccttcccttgaatcagagagcactagatgggaagggtgatgggagctacattatcactggcagatggaactattcagctcctgtccttccattctctaagaaccatgcatgtgtgtaaacacatgttgcatcagtgattgttccaggctttgcctacttgctcccaaacatgtgaaaaagaagaggaagattaagtaagtcattcatatattacttatatctgagtgtttgcaatcatataggggagcatagttcccacaaggaccggtttttgtaaacttttgcttctctttcctgtatttaggcattatatagctatggcagtgatcacccacaggtacaaattctgtatcattcattgcctttacttggaggtttacaaatatttttagtctctacttctttttcaaacacaatcttgaaacctcaacatatgaaacgaataaaggaaaattttgttagcataatgtatgttagatttcagcgtgtaatgctgacttataaaatcaagaagaaagaacaatgaagctttgtgatgaacacagaaatttgaaagcagtgttagagatgacagctgcaatcttctttaacttcagtttccaatttattgccttttgttgttaggtatattttttatgttgttgtgcagtattgagaaaaccctgattccctaaaataaggagttgcaaataataatgagttgttttatttttttaaacagttaccttgcaagctcaggatatgttttcctttaaacttatccacttaaaacgtgttcacttaaaacaaaaggaagaaaagaaatggcttctttcaaagctgatatcgctaacaatgtgaaaccatttacattttttaattggtaagcctgcgatttggaggaccaatgatagcttcctctagcctaaatcttccattagagggagaaaacactttttaaattataacattaatgagatgctcattgatgtacttaaaaaacaagaagaagaagaaactcataagcctgagggagggctcatctctttcaattttagaaggaagaaattgtctttgctttgcatggtgggtccaatcttgaactttagatttaatctctgacattggctaccataagcatggtatgtctgacagtttaatgccaataatttaattttattacaccattttatactacatgtttatttattacataccaaaattcactgaggacaagaactcagggtgttttgtctggtcttggccgttaattgtccatgatacactcatgctgtactagggtgctcacttgtgaaatttcatgcaagtggacgtagggagaacttaagtttatatgtttaaaaaaagcaatggtagcgctacaacctttctacctgagaaacaggatgtcactgagatgacgggatacctttattttgagatctacacaagcctggcagtatggtctggcccattagtagttgtggcaatgccaggatggaagttacatttgattaacggggtaactaagaatctaacttcagaagaactcttgctatcccctttaaccctcacaacaacagcaacaaataaatcagttggcaaatcttgaagatgtagagccttactaacaaaatggagttaagaaaacccttcatgcaagcaaaaaagcttgatctctgctagggacatcaaaggtgcagtggtgtggacgtccagacacagatctgatgtaggctttcctcttgggccttagcctagctcagtggttttcaaattccactgtatgtgagcattgttgcacagggtggtataaacaaaaactgtatatagtgtccttgttgggcaatgtaagacacttttatttattgagccaatacttacagagtgccttctctgtgctaagactcataggtgctgcagtttgagcaaggatgaagagaagtcagttaatgggtgatacaaaaatacagttaaatagaaggagtaagttttaggattcaatagtacatatcacttgtacccccaaaatatgtacacctgtgatatatcagtaatgaataaataaggagcatcattctagcgcaggaaacaaaccaacaaggactttgtggtgtaacatcagctgtgatgaatgaagagaagaatcagaggggcgagggaagagggggcctgctcttttagacaaggcgaccagggagggacacatcacagcagagacctgaatgaagagaactcatttgccagaggagcattctaggtaggaccaggattgtgcctggatgtggaagggagtgtggaggccactatgctggagcagaacatagggaggagatgggcaggaaaaaagaggaggagggtttcacatagttggggtcagatcatgtagggccttctaagtcttgacatggaccaggactgtggtttttaccataaatgtaataggaagcattgaaaggtttgagtggaatggtattaggatctgatttgcaccttacaatttcaaggatacttttgaacccacacactctgcattgggtgggaactttagaccctagcccctgaattaagtgttattctactatatggcacatggagagcttttctgaaactacagttacttaataatgagaaattcaatttaaaaataaaacgcagatgctctgaagcccgttggtagaatctttggggcttttaaataagtttaaaagctacaagcttcaataaagattaaattagaaatcctatataaagcttctaagagtgtaactagcattttagtaatgcttactaagtgctggttctgtccctttctgctctcctattttttttatcagcgcctttgctattaggccaggcgcagtagctcacacctgtaatcccagcactttgggaggccgaggtgggaggatcacttgacgccagaagttcaaaaccagcctgggcaacatagtgcgattctgccttgataaaaaataaaaataggcagggtgtggtggctaacacttctaatcctagcactttgggaggctgaggcaggtggatcacttgaggccaggagtttgagacaaacctggccaacatggtgaaaccccatccctactaaaaatacaaaaattagctgggtgggtggtgggcacctgtaataccagctactcaggaggctgaggcaggagaatagtttgaacccaagaggccaaggttgcagtatgctgagatcatgccactgcactctaacgtgggtgacagaacgagaccctgtctcaaaaaaattaattaattaaaaatttttaaaaaatacaattaaaaaatacctttgctattgatgtctgtttctgattgtctgtcatcccggtacactatatttactttccagggaaactgagtcattcaacaagcctctggcttctagtgataagcactatcattagaaagaattatgttctgtgtgttaaggataagggacacattctttttggaaaatagtgcttgtgagtctaggaatagttgtataatctgggaatatatgctaatgctatagctgagttcaaatcacttttttaaaaatgcaaacttatcttctctgtcaccaagcatgtcttccatacaaaaggcacatttctgtagcttcatccatgttactctaggctatttcctctagtttattaaccacacgctcagcaaactgtagagagtatggtctgatccctttctcccataataaaaattttaagactatgtacttgttgatagatgacaccaacaggatatattttacagaaatgaaacaacaacatgtgaagaatattttaggtcactgtaaagttcctttaatagaaaaaaaactttagatttaactgttaaaccctttgaaaaagaaataatttatttcatgcaaatgactaaagcaaaatggagtgtgcagaagacctacctgcatactgtatgtaaaatacagttttctgggcttcactcccaggaattctgattcacaaatctggggttgggcagctttcaattttgagaagtgccccgagtaagctgatgtcaggaatgtgaattttaacaggcaccccaaaggaaggctgtgggaaaccacatttgagaaacactgccaaattaccaaaggaactttaactttgtgttatagaaatatcaaacacatttaacagacacttctcaaaagaagacatttatgcagccaaaagacacgtgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgcaataaagacacatgcacatgtatgtttatggcggcactattcacaatagcaaagacttggaaccaacccaaatgtccaacaatgatagactggattaagaaaatgtggcacatatacaccatggaatactatgcagccataaaaaatgatgagttcacgtcctttgtagggacatggatgaaattggaaatcatcattctcagtaaactatcacaaggacaaaaaaccaaacaccgcatgttctcactcatagatgggaattgaacaatgagaacacatggacacaggaaggggaacatcacactctggggactgttgtggggtggggggaggggggagggatagcattaggagatacacctaatgctagatgacgaggtaatgggtgcagcacaccagcatggcacatgtatacatatgtaactaacctgcacattgtgcacatgtaccctaaaacttaaagtataataataatataaaaacttaaaaaaaaaagaaatatcaaacacatttgaaagcagagaggtggtaaatgaacgcttttgccccaccaccccattcagcagcagagccaacatcgttttctctactccacctctgcacctggattattttgaagcaaattccaaataacagtattccctggaccttgcatcttcataacagattgctgttgactcaaaatatctataaaatattttactatttctataaatgattaggattcttcttctcatacacaactacaacatcatcatcacaccaaaaaatgcattaacagtcatttctcaatatcatcaaatatcccgtcagtattcatattttcctaattgacttattaataagttttattttatgttgtaggattttttaatagtttatttgaaccaagatccaaataaaggtcatttcggtctcctaaacctcttttacactactcggtatcacctatgtcttttttttattttgcagttttttctgttgagaaaccagaccatttgtctggtagaatttcccacccgtctgggtttggatgattgcctccatgtggtgttgctaagcatgtccctctgtctcctgaatttcttgggaattgctaggaagttctagaggcattgttttgtttgctttgctttgcctgactgcttcatagttggtgttgtgttgtgtatttccttcaggaggtaatggttggtggcatctctttttgcagtgagactgtcatctgaattcataaatttatcagggattgcaaatagtggtagtctaattctattattatttgttcatttgttagcaggaattattgttcatgaagagaaactccttgcatctgtaatttatctacccggtgcttcaggttttgtaggaaaagcaggataatatactagattctgtctatttaccaatttgcacgatacagctagttcacagtgtcaaaccaagtcactgtgttttgaaagcatgactgtaaattcatagattgcagcatatctgttgtgtttcagtccatgacagtgattaccctttttcatgttcagatggtcccctgtctgagcattgggatcctattcagtttggctactgagtccttttaatccaatactggctgtctttgatagttttcttgctttctagtataacactatgttccaggctcatcttgtacatttcttgccttagctctgggatcagcttttttccaaggagacctggtttctttcagtgagaaatgatatttggagaccaaagactgggccccaggggaactgttctcactgggttgaatattgtttttcctttccagtggacacagccagtgataggaaatctgtgtctctctagatatagatatagatcgattgtgtgtactttttttttttttttttgagacggagcctcgctctgtcgcccaggctggaatgcagtggcgcaatctcggctcactgcaagctccacctcccaggttcacgccattctcctgcctcagcctcccgagtagctgggactacaggcgcccgccaccacgcctggctaatcttttctgtttttagtagagacggggtttcactgtgttagccaggatggtctcgatctcctgaccttgtgatcggccctccttggcctcccaaagtgctgggattacaggcatgagccatcgtgcctggccgtgtgtacgtattttttaaggtaaaatacctcatgagtttatactgatgtgccacaaggcttttacttaacttcattcattttacatcagtattttctttctctcaaactgaaaatagcagttctcactcacaccaacacaatttactcatttactttctcccacactacacttgcaataatttccgaacaaaaatgccagtgacattgcaacaatatgcttactgaaaatgtttaaggttttttttattttgattgtttagttttgtattggtttttagtccactgggctagagatggacaattacattacaatatgttagggtcatttggaatagttacagtctgtgtgtttatgccaataactggatatacatttgagttcacttactttaatttgagacttcctaagaggcttttgaaaagtgattcttgttcaataattatataaaaatatttaaattttcctgaaacaaaacccacaaaacaaggtgaagtcgttgaagtctgtctttcatgcctgtctgctttattttctcctttttaccatttttaggcatatctttcatttttattataagcaatcatactatttaggtaggtttttttttttttttttttttttttgctccaatagatttatttatttatttagagacagggtctcactttgtcacccaggctggagtacagtggtacagtcttggctcactgcagccttgaactcttaggcttaagcaatccttctgcctcagccccccaagtagctgggactacaggtgtgccccaccatgcccgctattttttttgtttgtttgtttttccagaccaagccttgctctgtcacccgggctggagagcagtggcaccatcttggctcactgcagcctcaccctcctgggtttaagcaattctcgtgcctcagcctcctgagtagatgggattacaggtgtgcgccaccacgaccaggtaatttttggatttttggtagagacggggttttgccatgttggccaggctagtctcaagttcctggcctcaagtgatccacccgccttggcctcccaaagtgttgggattacaggtgtgagccaccatgcccagccttccagtaaaaatgtttagaataattccttaatatggtacccttcttatcccccaaacttttcttagctgttgtttattggtttccaactctgagtgattttgaaattcttagtaccctttctttcttattttcttctctggctataatttgatttaaggtaatatccttttactcccacttaacatctatgttagtgagattattttcgttcctttcatattcttcccgcgtgtttttttttaatcattatactatctatattgtcagggcacatagtcattatatcgttctggctatatgtaatattgtttccttgtaatcatctttcagtaacagacctacagctgattatgtgttaaatgctcacccagtctttgtatcagtgcctttccagccagactggttgcctgactcttctcccttgcagattactaagggtttctgcgaacaatattccttgggtccttgcatattcataacagattgttgttggctggaagatcattttggctgggtataagatccttggcttagttgtctttcctgagtgtcacgctactgacttttagcatgaagcctggctcttgaaaaatcgggtgacactctaattttctgtcccttataggtaactcagtcattttacctgagtgtccaaagaatttttttttgttttctttcctaggtcagtttttccaggtgcatggagtattctgtcaatatatagtttcaaatctttttctacttctagaatttgtgcttcagtcacgattttaagcatttgctgtttttattgcttttcttcttcaaaggctcttattacagtgttatgttgggttttctttgctcatgttccttttctgagtctttctcttgaattctatttctttcctcatttctttttgatgtttaacactttctcctttctattttttagcactcctcaaagattatctgttgtatgtattccctcttgtgttccttcttatttggtcttcatctagaaaatggattttcttttttcgttttcttcaaattctttcccacgttcttttgcctctctctatccaactatttcttttctccaatcacttcatttctgaatgtttttattgggattagtgttcctttatctcttcttactgcctcattttcttttagctcttttgaaatattaaagttttcatctgttttgggggcatgtctctgtggtaagaatgctactctgatttttcttcttataataactgtgcactgtatttgaccacaatcctattttgttactcatttttaagtggaatgagttttcttgtatttttagggataagggatgggccagaaaatattttctagtgtctaggccatagaactccgtcttctgttgtttccatggaataaaataaggcctatattttcttagcttcgtcttctctgcctcccttcacttggatctgccccctcccttcactttggctaaattattactgccatgttcgatttagattctgctctcaaaagtttcttctcaaggtgatttggtcgtggaaggaagcttagatttgttggtctcaagagtgccctggctccgtaacacctaagcacctcagaccttcccagggttccttgccctcaccccatgaattggattctgcaggaccccttgccaatgatgctgctgtgctcaaaatagctcaccaccctgctgaccgtgccgtaaggacctttggaagcttgggagcccgttgtgccaaaaccttcagatgcccactgcctctcctccaactttctcttgcacagatattgcttctgcctggctctgtcactataaatggttcggccacacccattcctgtcttcaggtttatggactacacagtaacctcattttgtcttgatgtggtccatgggtttttggctgtgtaattccaatttctctgtttttgttgttatcattgctattgttactggcagggaggaggagggcagggattctgaaaaatttttttaaactgtgctacctttgacactggtgccatcatcttccctgaattcccgctttaattttttcttttcttttcttttttttttttaagacagggtctcactctgtttcccaggttggagtgcagtggtgctattttggctcactgcaacctctggctcctgggttcaagcaatcatcccaccttagcctcccaagtagctgggactaaaggtgtatgtatgtattccctcttgtgttccttcttatttggtcttcatctagaaaatggttttttttttttcttttacttcaaattctttcccacgttcttttgcctctctctatccaactatttgttttctccaatcacttcatttctgaatgtttttattgggattagtgttcctttatctcttcttacttcctcattttcttttagctcttttgaaatatcaaagttttcatctgttttgggggcatgtctctgtggtaagaatgtgccaccacgcctggctaattttttgtatttttggtagagatggggttttgccatgttgcccaggctggagactcctgggttcaagcgatccacccatttagacctcccaaagtgctgggattacaggcatgagccaccgcacctggccccacttcaatttttttttttttttgagacgaagtcttgctcttgtcccccaggctggagtgcaatggcaccgtctcagctcactgcaacctccgcctcccgggttcaagtgattctcctgcctcagcctcccgagtagctgggattacaggtgcctaccatcacacccacctaatttttgtatttttggtaaagatggggtttcaccatgttgcccaggctggtctcgaacttccgacctcagatgatctgcccacttcagcctcccaaaagtgctgggattacaggcgtgagccactgtgcctggccccactttaattttttaatagtgcttgagaagatgtttctgctaaatactatgcctctggattaaacctcaaatacttcaaaatgaaaagtttgatttcggtcacagatttttagtaaatactttttagggacaagaaaactacaaagtgctttgaaaaacaaaacaagctcaattttttatttgtttaacatatgtagaaaataaaattaatacacgtatcttttccaaattaacacagtatgaaaccaaccactactaattcatcaaaagacacaatttagatcaagtttaggcttggttaggacgctggacgctgagtaaatggtagctctgaggctgaaaaaaaacccctgagtcactctggtacacattctgatgtcagcatccccaccccaccccaacccttattcccgccccgcccccggccccgccccccccccccccccccccccgcgaaaagaagtctctagctctgaaaattggcttgttataactttacaaatgtagttgccaaattgccattgacatcacatttttctttttggcttttagtagctagatagtaatactataaaggaactctctgctttttctattttgtcctttttaaattcttggaggcccttcataacatggaacacaggatgggcaaacgtgcttcttatagtgtaggttagatttagcaccttttgacaaagggccttgtttcctgtgcagtttaaatttagatccactgagaatctgagaaattcagtaatgaaagggtaactttggagtttcctcttttggaagctttccttattaaattctattaatgactctgttagacttgattcccatcttacacaagagattccagaatagcaacttgaattgcttcttagtccctcttacgaagtcactccttcatttggcattgatcgagtacctcccgtgtactggctgacggggcttatatacagagccactaccttatttttcattctgttattttaagagtttcttgatagtccatctacttaagaagtgttgctattaaatttcagtctatctcataaatattattctgagatcctcctggctggatttataggtataaatcattcttggataaaatatacaatataaacagtaagtggaccagttatctgattatacgtgctctgagtctacagaaagacaatatcttggtatgtttcaggagacttgtagagatgaggtgtaggacttctcatttctaattaaaactaattaaaatttactgtctacaagggagatggattgaacatcacctttacctttctcttgacagcaatgaaacctgactcaaagctggcactaaatgtattatttcagtatctgtgtcctattatgtgttgtaatattttggattaaaaaatggagaaaaaataaacaagaaatttttatttctgctaaaaagtcaacagagtccattgttatctttctttgcttttcagatggcagaaattgggtgtcaggtcctataacacaggggttcccaacccctgggccatggaccattatgggtctgtggcctgttaggaactgggtggcacaccagtaggtgagaggcaggcgagccggcattagccagctcagccagcctaagctccacctcctgtcagatcagtggcagcattagattctttctcataggaaagtgaaccgtactgtgaactgcacatgtgagggatctaggttgtaccttccttatgagaatctaatgcctgatccccctacccctagcctcatggaccagtgccaaaaagtttggggaccactgccataagaagtcccgaccagaagtgtcacatctttctattgcatgatgctgcttcttgaacacccatagtagccaaggccagaattagtgtggcaccctcttccccagacaaggtccatggacagtgcatttcaaaatacaggaagctctccttacactctctgctacctagcttccatggttatcaagtaattatactttatgctgagccaacttatgcatttaggaagagatgaagagaaattatatcctcaaatgggctggaacaaaagggaataccaataatttgtaagttaatcaaattataattaaagcaggaagagacacaaggagcttggattatctatgttttctgttagaaaataatacaacaaaagtatccagggagtcttatcagttctgtaggaatttggcagaacagtaaggttataagttgtccttttaattcccagccacctctggcctctgcttaccatggccctgccttctgacttgctgtttgctcagctccttagtgcatgggaagagcagaaacatcaggggaagagcgctgagatctgctgtgcacctgtgccgcacagcccttcccatgtagacatgtgtagcttttgggtttgccagtggatggaacttatccgcatcaagtagccttccacgggggtggtgctgatacgcactcccacccacagccgatacagcctaatcacaagtggaacaatcagagtggaaagtagcggaaagtagcagcctctggtttccaaatgtgagagagcctcagggctcagtcctcaaacctggtctgttttttgttgatgccttcaaaccatctcaaaactgacaccttctccagcctgggccttttctttgaacctcaggcttgcatatcccactgtctcttaactgccttcagtgggatgaactcttgatattctaccccaacctgcttctcccactgccttcccatctccttccagttactcaggccacagttgttgacgttgtccttgatgcctctttttctcctacacaattctgctggtccacggtgccaccatctcttggctggagttcatcagtaacctcctgagtagtctctctgcttcttctcagaatatctcctccatgcaacagccagcatgaactggtgaaaatgtagtccagaccctgtacctcctctgatcaaaaccctccagtgcctctcagctcactcagagtaaggacctcagactttattgtggctcaaagaacttgtcacccccaccctctgacttcatttcctgctccccaccccctttactcagtgccaggaacaccacctcgatggtgttcctccaacacaccacacaggagcccaccccaggaccttggtaccttctgttctttctgtcaggaaggctcttcccccagtcaccacattgctttctatttccctttcttcaggcttttccccaaaagttactgtctctgtgaggtcttttttgactgacaagcttgaaaaaatggtcaccagaccaccaccctagcccccttttctgcttaactttttagcatctatcaccatttaatggaaaatacttcattataaatcttttatttccatgaggataggtaattatttgttgttgggggtgtctttgtcagcatctagtacagtgcctggcagatggatgctcaataaatattgatttaatgggttatgagggtgttaatataaaattagcatttattcagcaactactatgagtcagccactgggctaagtggcttacatgttaagaacctcacagaaggccaggtgtggtggctcacgcctgtaatcccagcactttgggaggctgaagcaggcagatcacctgaggtcaggagtttgagtccaggctggccaacgtggtgaaaccccatctctactaaaaatacaaaaattagccagttgtggtggcaggcgcctgtagtcccagccactcaggaggctaaggcaggagaatagctggaacccgggaggtggagattgcagtgagccaagattgcaccactgcactccagcctgggtgacagagtgagactctgtctccaaaaaaaaaagaaaaagaaaaagaacctcacagcaacctagtaggtgagcactgttactcttgttttacaggtgagaaaattgagccctagagaaataaagtaacttgcttcaggtctcatggttaaggggaacctgggccctaacagtccacttcctgtaccttcaaccacggctctaccgcctccgctaggagatggcccgaggacattccttagctggcttcagcttgctctttttcccctgcggtccacccctgtctcctgcttggtcatcagtgatttccatgccatcccatgtcattggaccagttgtgtgtttttaataggagttctcatctcactttctccacagctttgccaattctgctctccccctcctgtctaaataccttcctcccttggcttcctgaacaccactgtcttcgggtgccatcatccctttctggcccctccttcctaagtcttcaggtgttccctttctacctgctttctacgcctctaagtgttggagttcctcatggcttagtctctagaccactttgcttctccacttaagtgttctgctagatgatctcatccaaactcacagtgccttgatggatccatgactcctgcatccatgtttctaggccagacctctcatcatcttcgggcctgtgtctccagctacctactctgcacctcctttggggtatcacaatgtcacctgaactcagcacgttcaaagtcaaagttataacaatcaccatcccaccaaacctcatctacccaagaattccccatctcagccattggcatcatctagttacccaagacagatgcctaaaagtcctccttgaagcatttctgtccctcttcctctgcatctaatgtgtcaccaagtcctactgatgcaatctcctcagtgtctttcgaatgcactctctctcttccggcccactatcaccattctagtcctaaaacctaccttctttctaggagccacagcttctctggagtttttacacctcttccaactgttcccatcaccccgttcttttctttgacaacattttttacatataaaaataggtatttatgtgattatatcatgaatgtcttttctccccaactaagaagcactatgagagcagggagcttcctgtttctccccgttcaatcctcagctcctagcagcacagtgcctggtgtatagcagattctccatcagtatttgatttgttgagtgaaaaacttagatgtattaaatgacaaactgagatcaagggagaatgaagaatcaatcagaagcagatagaaaattatgctgtgtggtatggcaacatcatgaatggactgttaccgataatacacactgagtcatcaaagaaacattaacatgtattctctattttaaaagggaggtacataaatatagaaccaaataaacagatctcaggaacatttccattcagtaagcaaagttttagaagggaaagagaaattaagttcacatcatttcccaataacacagatgaatgttttccatccaattctgaggacaaagatagcacctcctcgcccatccatgccaacggaggctgaggtagcacagataattgaaattacagtgaagaaggaaaggggttgattgatttgcatgccatctcttttctttaatagtggaggaattgccaaaaaaggctaaaaatgggcaacaggaaaagggagaaacagtaagaatcttggataatcttccactagataattaagacttaactgggtctgttttgatgtgtgcacatgtttctgtacatggagaaggatgaacccacaaatattataaatgccaatttccgaaggcttttggaaaatgtaacccatagcatatggtgtcaaattaatttggggttttacttgtttcagtctgatttgggcacattgaattatgagataatagtttggcatccatgtttgctgagtgcttgttgtaagtttctcaatttcacaaaaattctctgaggttagaggacgcgtcgtgaccctcgtttggcaggtgaggaggtagcggcacagagccgatccgtggctcgcctgagctccggcaggaactcctgggcggagctgctgagacccaggtctgcagactgtcactctggcttcactatttctggccttcctttgagcacttttcttacttttgttctgtttcatgcacttaatgcacctgtttcatcatgctgcctgtcacagttaaaggaatttaaaacagaatggatcgtatttgacagtaaggagctgtacagctgaattccatcaagacaatgtgcttgtagccccaacggcattaaaactttcaaatgatgctttatcacaacttcctctgggctgcacgtgacaaaggggtgcttaaccaggagggacatctctctttgcttgtaggggcaggttgctgttttttgcccacctctaaaatctccttggagcactcagttcttcttatcctccttaaagccaacaactataaaatttaatttaatgttgaacagctgtttctgttgcggtccaggtgaaatttgaggtatcagctaattgtgctaaagttcccaaaaagaagtattcagaaggtgtggatcaccaattacctcttggcagagctgtgaactaataactagtagcagtagataatgtactcagatgccacatgaaatgcaaaagattctatgctttattccataaagcatggctataggacattgtctactatgtaactaatatttaaatatttatagatttttaaaagatttcttcaaccttcttttctcaccctgtttctagatctgatgcacaaaggaaaataataatacaaaacccataacctattcattgtattgttgcggtagatcgagctacatgctgcacagcaaaagaccttctttgcacttctttcaagcagaattattgctgtatattcactctgaactgagaggtgaggattgaactgtgtagtgcctcagaaaatatcaagagttttaaaacattagttttgagagattgaaatacatagaaacttggaatgtttgaatgtcagcccagacattggcaggcttccatgcagatttcattgtgagtaaaatgtgtactcagtggctgggttcaagcccttcatagtttataagcaaatgtctctgcttcttctagatcattgcaaaaaaaaaaaagaagaagaagaagagaagaaaagaaaaaagaaataggttaagcaaattttgtggtggtgcttatgtgtgcacagacatgcatgaggcctccgcatcttccaaacttggaaagcatattttaacagcacaaatatatctacatgtttgatctacatcagagcctctttttttccctcttccttgcatgcttttaaattatatagtttaaatgttttaactattaaatctgtttggtcttcaagctgtaaacatcacacacagctaataagctttaggaaagaaaaggaaattgacatttagtatagaggttctacaaaaccaatgaaaaccatgcaaatgagctatggaacagagagatttgcatatcctcgttgatttcatgatgatattctcagcatgagcctggcagccttgcctttttacctcttgggatgatgcatgtactggtggtagagccctgcagggtcaatttaacgagtgtaacattgtgattttccatgcggtttctcagaaccactgagcaaaatgcagcaataaccagtgacagaggaaatcgatttttgaagtaaatacttttggaggaggggaagaaggtacattcccttcatatttaatgttgccaaagtaggttgaacaagtttttatattagtaccatttggtatttcaaaataaatagattatccaccatttccatcactctctggataccctcacatgtttaccaccaaaactcctgcgcagagactggtcctcttttgcaaactgcctttggctcccccgcgatctctcatcagaaaagcaggctaaggaatctgcttttgcccccatcctgttagaatgataaatagtagcctgatggccaagttgtatatttatttaatacatcgtctgtattgatagtttatgatgtcctggatatgaatacacgaaagcacagttgcatagtggcgaagaaggattttgatatcgtggagatctggatttgaactcaactctggcagttctccctgccttagtttcttgcccgtaaatgggggtgatgaggtagttgtgagaattaaatgagagactatgcaaattgttataatactccctggaaaatagttaaatacccaatagatagcatcactattttgaaatgctttcaaaattatactcgagttttacttctgcaaaatcaaggcagctttcttcagaaaagagagaaatgaacttcacccctaaaatgtacttggagaattttagagggtcttttccaagttgttataaagcacttctgaagtgaatttgcccatttctgcccacaccaatcttataacattccaggaataaaatctgcactcgagtttaaaaataaaacgggtggaacaaactgaattagaagtccttggcagacatcccccccagcagaatgttctctcaattggtggtattgcaataaaagagatgtatattttttagtctgctcttcctccctgataatttcagccagttgtatttctctattctaaaaacctggtatgcttggatttaatctcaccactcctatctacgctcctgctcctacccccacacccatttcccccaaaaaaaccccacatctgcacagaccctccttcccaagaaaacatggaggcgggctgctctctgataccgtacatgtgcattccggactgtgctgaggaaggtcatagaaacatgagagggctctgctgttgtcagttgtaaagactgccaagaaagaacaacaaaaaaatctcaaatgcattcacatttctcccgcctcttttttcttctgtaaatattcaaccctttttagagaggcttttgataatgtgttatctcagcaaacaccacgaaccttggatgtacgcagtactccctaatcccataggaatgactcagtcaagagagttagatgaaatatggttggcaagattgggtggggaatcttgttactacacacacatacacacacacacacacgcgcacacacacacacacaccagcagcaccagccactgcacccctatcatcgccatagacattatgtaaaaactagacattctcctctcccttacacagtcagttgcatctttcccaaaaatggaaggggaaaaagctttctttggctgagccatatgcaaaaaatcatggaacatctgtgtaagtaacaacatacaacaagacaaattattggtggtaaaaggcaaagcccttgtttcaaaaacatgtctggaaatagtgtgtatacagaaccttcctttgtgctaattactcataataactgtcagctttgtgtaccacaggctgggctgttaataactagtggtcgcagtacggtgttctttttctttccctttctttttttttttttcctatccttccttccctctttcctgccttcttttcattgttgttgcacaaatcatatagccttattccaatagttgctggaagaccaaatcagagatgtgggggattcagggactcgcgacatcttggagtatactagtggataaatgccacttcacccctgatgtggccgtttccctccaacacttgtctaaggagtgcagggactttggggtccaagcaatgtatcagtaaacttcagaatttttttcctaacatttaactctattctcagtctcaacacccgccacaaaaataatgtcactccaggcaaatttagtcgcttacggattctgagtcttattgtgattttgcctgagtggcaagcttttcaggcacgtgtacttaaaaatgtgatgtggtagaatttgcctccagctaggaatccacagacttgggtttgagctccacgtcccacagtcaccacgtgatcttcagaaaagaatcactgaactgcctgtgcctccatgcccccgtttgtcaagagggaggtggtaatacctgctgcggtttttatgtggatcgaatgggcctaaaactcatagaaacacagaatgcttctatgataagagaaaactccagccaggctcagtggctcacacctgtaatctcagcattttgggaggccgagatgggtggatcacctgaggccaggagtttgagaccagcctggccaacatggcaaaaccctatctctactaaaaatacaaaaattagccaggcgtggtggtgggcacctgtaatcccagctacttgggaggctaaggcatgagaatcacttgaacctgggaggcggaggttgcagtcagctgagatcgtaccactgcactccagcctggaggagactctttctcaaaaaaaaaaaaaaaaaacgaacaaaaaatactctgatgctattgctactggttgtttttttttttaatgctaaaaggactccaaacatcctgttatcacccactgtcaaatttctgcatatattttgcagtgccagtgagaaacttggggtctctacagtcagtaaggaaaaaggagtttgaaagaactaagggatctctgtctatggggaagaaatagtagggcagagaatttaaatttagggttcttaggaaatgatgcaccagggccaccgcacagccctcatgtctcctctcttcagtgtcctctctgcctccatcacctagtgaggagggaacaggtgcaggaacaggtcgccagggtgtccagcaggtgacctcccacccccctaccctcgccgcccccactgctccactggcagcctatgtcccaaccaaaccttacttcacattgtaattctaatgttctgtgcgtgttcatcgccatatttccctccatctgacccagcccgtcaaaatccttcctctacttcagggcccagctcccatcccctcttccgcaaagccttctaaccgcaaacccattaacctctccccacttggggcttctgagtccctttattatttatggttaggagaaagcatcacgtcggtctggtgatgtgtagtgagttgtgtgaatgtgttagcagagcagggtggccctgcatgtgatggttgggtgttagctggagtgagccagcctgggttcaaatctccctctggcatcagcttgtgctgtaattggggtaagtgctgaaactctccctgtctcctttcctcatttgcaaacttggcttaataatgatagctacctcaaaaagttgttgtgataattaaatgaatgtcaagctcttggaacagtgcaagcgcttaagaaatattatgttggtgcaaaagtaattgtgattttgccattactttcaatggcaaaaaccacaattacttttgcaccaacccagtatttgctattactagtcctggtcagctgagcatggtggctcatgtctataatctcaacactttgggaggccgaggcaggtggatcgcctgaggtcaggagtttgagaccagcctggccaacatggtgaaaccccgtcgcaactaaaaacacaaaaatgtgctgggcatggtggtgagcgcctgtaatccctactactccagaggctgaggcaggagaatcacttgaacctgggagccagaggttgcagtgagccgagattgccccattgcactccagcctgggtgacaagagcaaaactacatctcagaaaaaaaaaaaaaaaggcctggtctaccagagacaagaggccatgtcttgtccatgaaagccttgcaaccatattttacagatagaaaagacccagtccatgaacattaaagtcagtatcaggtacatttatcaacataaaatctgttcctttgaatcagctcaataataaaagagtgcagctgagcaccccctcccacagccccatgcctctagtcactgaaaatctgtgaggaatttttatagagtgtttcagaacagagcatttcaagacaaccctagagccctatggaatacattttcaatcatctttctgcgtctgctttcttttttgggtgcacacagcagacactggtgatgaggcatgtgcctgtgtgcactgttgttttatagaagctgaatgaaagcctgggagttgtatctgcctgaaaacttccatcctggcttctagagctcaacacctgaaacgctggaggcagttgaggtcactttgaaaacggaacccttgatgttctgctcaaactttagaggcatttacaacaaatcaggcaaatgaaagtgtggaaaaatcagaaacgaggaccactctgtcttagggattttgtcattgtatcgtgtgtgtgtttatgaatgtgagtgtgtgtcacatgtgagtgcatttaaccttcatgcaataagagagtagttttccacttagaaccagccaactctctataaaatttacctccgtgattctaattttgctccctccgccgtgggcaagttggcaatgtctgaatgtctgaagtcatttttgcttgtcacgactggggaggagctaccagcatctagtgagtagaagtgaggaatgctgctaaacatcctgcaacacacaggacagcccccaccacaaagaatcatccagcacaagatgtcaacagtgccaaggctgagaaaccctggtttaccttaaccttaaaagaacaattcgaatgcttgggaagggatgtctgccacatctgtactggagagaagcatggcccccagtcaaggacatggagagttccatgtctggatctagaccgtgtccatccacaaagatgcctcctgctcttctccgacatacaatctggtccatgagaatagactttattggtgagggggcggggctttaggtgagcggcattgaagggcttgttctgagcttggcctctgctggcagattattttctggccactttaatctcgatcctgcctctacttggtctttttttttttttctttcccccagtttttggatcttatagttccacaggacaagatacatctaagagatgggggaaaaggttaaagcagcaaggggatgctggatagagggggagggaaacaagaaaggaaaaaacaagacagagagacagagatagacagagatgtacaaatgggggctgcttggttaaagtgtcctggagttttcagcaagagattttgctgccagtgtctctccatccttctctctgcctctctctctctctctcacacacacacacatacagacacacacacacacacactcggccccaccaccacacacaggccaggtggctctgcttacatacatggcttggcgcttttactccttggctaagaccatttcacacatgaacaacacagcctcctcctagagatttgtcatccatctgcttgcagaagagctgtctgtttccctctgaaaattggtccaatcaacattttcctttggccagggtagcttaccagcagctcctccataaggtccataattgcaatttctcattctcatttgcctggctggcttcacccttctgtcctctctgcaccttcccacaagtgccccaccctccccaccagccctctcctccttttgtgttaataagccctgtcaaaatgaatgacagaatcaacttccttctcccaaaatggctcattactcataaatttcaagcaatattgccttctgtcctcaaaaggtttgcagatttttttcccccaactgatcccctttccagagtgaaatagcggatgaatgccttgcctagcaccctctctaagctctgcctctgtggcagtattgtgggccaatatgccaacgagtctttccttgtgatctgctccagcctgtcttgtgccatatgcttgtggcagacagtggttaatatcagtctgtgagcatcttgaggctagctttgaagtctaattctaatgtcatcatgcttatagggtgcacactttgtttgttctggaacagagggtcatctgctacgggatgtggaacactgaccctgatattgcagccgtgtttgtggttgagtgagggagcaggtgatgggcataggagggaaccaagccctgagccgtgtttcagggatgctcggtcccatcccctttctcccagatgacttcttattcttaaattttgaatagtgagtaacacaagcaggaggtgggatagcatgagaacttaggaaatcttcccatctctttgttacttacaagataaatgtctatactgaagctttagggacccagattacaactgaattgttttataaatgcgtctgaaatctgctgttttgaaggacaaagtaatacctgaagaatgattaagaaggcttagagaatccgcaggctccaaggtgtgtgaataatacctttccatggttcactaccaggtgatctggacctacagccagtcttctgtgtttcagtatattatgttgggagcattcccagacagttaatgcgtaaaatgctattcaaattctcctttaccgaaaggcattttaaagtaatacacgtgggtgaggaatacaagtgcctggtgggatacttttggtaaacaacgtggcacagtgggatggagtagggtctactttttcccaaatgtgaagttagtagctacagaggggtcctgagacagaaagcatttgtaaatattaatttgtgctctgtttcacagaatctgaaatcaggcatctgtgcactttaaaatatgaaagaactaagagatctagtgtttggtagcattttagagggaaaaaaggccatagctcaaatattgctctgatttcagttggctgaatttatgtgtaaagggcatgttagggaatagtctgcaaaggtaccagaaactgccattcatggaaggccctgagtgcaaaatgcagcagtcagtagttctgacccatgccattagatggttctggaaggtcctcagaggagacgcaacaccaacagtgacactgcttccagctcaggcaggctggagctgttctgagtcttcctgaaggttctgaatggtccagcccttggactcccttcagagagtcatggagcacccacatttcctttgcacctgaaacacttctttgtttctgtcttcaccctgactcctcatctattcagagatcccagctgatcctctctttcaaagccaggccagtgagctcttacagaagcttacttcagcattccttccaccgtcttctgagtagcagggcagacagagacagcaatggagaattccagttgattccccataaaatggccactttgttgtggggcatgagctggtctgtacttgtttgtgcctggcagtgcacacactagaaccctgggcaaccctggatgtaaatcaactagatactattattaaatagccgaaggtttgccagtgcagcctggagcaaagagagaggggtaaaatcaggctcccaacagacttccccataggaaacctctcctctgctgtgattttccagatgagctgcgtaaatggctccaaatcaccgaatgtttgtgcacgcaggctccattcatgcgcatgcacacacccggcttgtgtccttcttccctctcgtcccttgaacccgtagctcttgattctgcctgtaggagcaatgatgttgtagcaaccatgacaaaagaaacaaaatcagaaggcagatccaggccgctccctgccacctgccctctgtctaccttagacagatcacttaggcccactgggtcttgataagacatggtcttttcacacctgttcttccagtcttataggattacctggaggatcatgtgatgcgaaggatgtaaaagtgctccaaggggttaaaaggactttatataataaattcctacaaactgctataggcacagccatagctctgaaactagcattctcgtaaggctagtccaatccataagtttcgtttgcttcaagcagctcagatagacactctctgaagataaatgatgcataaaaacaccattgtttgtgatcagaataatcaggtaccactaaatagtcctgcatgtgtatgcatgataccagcagcctccaacttgcttctccaggagcactgtacttaacttggaaacccctttatttaatttctgtccactcacaaagcttcaccttgtcttctctcctctctgtcctcccgaggttaatccttgagagcctgtaatcaaggctaggccctgcccaccttaagtcaccctcccctctctctaggcctccacctcactggggagcgtcattgcagccagtggcaagaagctgcaaaattctctcatctgtgaagagagcccctaaaaccccaaatcccggaccagtagaggaaaccattgctgccctaatatcacatgttacaagtcttcgagcccatggtatctgagatgttaggagctagcattccttgtaattaaacccctggaacatcacaaggacccagttcagggggcttggttggttgactgattgatgacagcatctcaattatgtaggagatttctgtaaagaggagtgactggaaggaaaagaagataaccttcatttatatcatgagaccttgcgtagtagaaggccgtgaggatgggaacaaagtgaaatcatgaaaaacagcctgatgcaaaatgacaaagaagaatttcagggtcgttgagatcacacttgaacaataactgaacagagccagcactacagttttcagacctgatggctaacaagtgaaatgtattcagagagaggtgtgtgattataaagactccccctacccctggtgctctattccactgactgtccctttatgaaaaatgaattctagagttccctttctgaaatttcttacctgaatcagatcagatatgacaattctattttttaaagcaccttactgaaaataaagtgcttttcagtagtaaacctttaagattcctggtttccctctgacttgtgaaaatatgaaagaactgaaattagaccacattggcccaggttgggaaaacagatggcagagataaggcagatcaaagaaacatctctctgtgggtgaaggagttcctggttgtcatgtatccattttttgtagcgttttccctacttgaggaggctgttgtgaagggcaggattcttcactgaatctttattgtaaaaggcataggtgtgtcttgggtggattccagttctcaggttgatttgcttgacaactcttaggaaggaacaattaatactgctgcccctcaactagctagggagatttcactgtggaggtagaagtcggattcactgaggcagaattgccagggcttgagacccttcatgcctctcttttccaagtctctctctccaagaaagggtgaacttttcaagtcaaagagcagggacgtaaataaatgcagttatggctgtcttaggaggatccattcacttaaggcaaaggtcttagaagttacagaagaggagagagaatgggaactactgtggcaccaggatgtctggagaagagaaagtgcgcttactgtgcacagcttcctctccctcacctgcgccacggtgaacccacctatatctttctgctggcaaaaacatttgctcagtgtgtcgccggagtacttgagtgtctgatatttctcaaggcagaatctacctcactgtctctgaaacctcaaaatatgtggccctctcgaaggataacagttggcagcaacctaaggctgttctgctccaacttggaatgaagaggaatatgatttggccattcttcttagcacagaggcaaataaaaaaaaaaacccttatatacttcaaaagatgaagatcttacttcttactggctatctttgcaccaggtcctgggattggcatataataaaaaatgcatatgcagtggccatgaaatgggcttaaaggtcaatcttggctgccagtcgtggctaaactgcattgtattccatgtttttttccatattgcccctgcagtgtacatatacatgcacagtcatggcccctgcacactgtgtacacactcacgcctgcacacatgtatgcatatcaacgcctgcacatgtacttgtatgcacactcacccacacatgtgcatttgtgtgcactcacttctgcacacctatttgcatgcacgctcatctcccacaaatatgtatgcatgcacactcacgccccccccaccctcccgtgtgaaactctgcacctgcttgtctttaccctcacccttgaacctgtgtataacctcataaagtaggaagaagcccagtgttgaactctacagccttttacattcaaaatggttttgaaaaatgcccattcagaggaacaggaaagcaccaaacctaaaaggtctgaggacctttccatgctttctgtctcctaatctcagagctgtaccaatctgttatttaaaaattagtcattatttatccaaggcaggaggggacaaatgtaactgttagttcagtaaatgatttcattcttttttttttcctgtgtcctttctactgttaaagtgacgaaaatgacaccacggtttgatatgtggggttggtttcagtttgaataatctcatccttagctgcatgtgaactcatgtcttctcacactctattagataaaagcctaaaacaggaaggccagaaacaactgtttttaaaaagctcatgctaccctggcaacttaagttggaagaacctaataaataaatacaaagctgcccctctgtcctaatgtacttcttctgaattccagctgggcacctcatggtttcatgcctgaatcacaaaggcgagtgccagtacccagccagagcagttttcctaccataaaccagtaaatgtgtgtgtatcacatgtaagtcagggtcagatggggaaaatcaactacaaaaccgcagagacattatgcaaaattggattacgtacatgttttcagttttgtctcttagcagtttaagtctttaattaaaatacacacgagagagagagacagagagagagagagagaatctgtaactgttagattttataggccccggttatgagataatagccttccaagtaatttttatgggtcattctatctagtggcaacttagactataaagccatctcccagcttcccaaaagtaatgtctgttttctcactttctaataattacttcagatttgaaagtaaggagttgtcacagtgaatacaaattagagtcagcttcagggtattactaaatgtggattgttttgttccgagttttatccattttaggcagagtaacatgatcatttatatacatctgcctctatgcaggctgtgtagacatactcagaacaccagcttcacctcttcagtcttctaagacagtctttctaatactctatattgtctaatagctaagctattgttaaataaaaacacgcaaatgtttgcagttaggctcccccctccattctcaacctcttaagtgatacagacagtaaatgcattttgatgtttatttagaaagttggcatcctgggactgttcacaagatagctaatttgtctgaaggtccccagagacagtgaaagtcatcccaccatctctctagctgccctcataccggggaagtaaaatgcagcatagaacactgcagctcacgttatggagaacagtggtgctatggtgatttcctttctattcaaatcatttagtgaggatttacataatttgcattaacgtgtgactttcgatcacttatgctgcagcagagtattcgttgcctatgttctctaaggcaccagtgtggtggttcatgtgtccttgtataaaagattactgtcctccccatccccagtctttgtatctgtgcaccagaacaaaatgccctcggatcatggccacccaggccagagaatgaggacccacactttaaaaaccctgtagatgataggatgagcggtcctcatccgtcccctccctgagagtgaggttgggttggagtagaaggatggactctgccaaatgatgacagcagccctgagagtccttctcacaggtggccagctctgtcccctccagcctcaccacacattcccctagtacacaaaggcagacccgggcagccactcagcatgcacatgtagcagtgtcccctgtacactggtaccctcaaggcctccctggcacctttgcttgttacgttggctgatttcttcaaagggaaatatgggatgtggtgcagcctggccctcacacactctgaaaatagcactgcccagggccaggccttttcctttgcacactgccatacccaccctggaaagtactccatggttgtatcacaagaaaacagccatttgggcattttaaattactcaaaatattataaaaatatttataaaatatattaatgtatatatttataaaatacaaagagtatatgattaccaggcaaatgagtagacagtgatagaactatcataagaataggattggctattaattataataatgattggaatagataacatttattgaacatgtattatgtgccaagcactgtgctaaaatatttacatgcagcagttcatcaaaagctcatgggaagccatgtgcagtgtcatgcacctgtactcccagctacttgggtggctgaggcaggaggatcacttgagccccagagtttgagcctagcctaggcaacatagcaagaacccatctcaaagaagaaaacaatacaaaaagctcatgacagttgtaagacatatgtaccatcattacccttattcaacagaaaaggaaattggggcttagggtgggtggttaccttacttgtacaaagtcacacagctagtaagtggaggagttggttcaatgaaggataaccagggaagcatctgtgggcatatcgaggcctgaaaataggaacaccttggccaaatttcagaccatgacatcaagcgaatgcttgaaagctaaggaacaaatagaaatatgttgtatcatttataacaaattgttaccattaacacctacaattattagcgttaggagtattgcggtgggaattgaacaatgagaacacatggacacaggaaggggaacatcacactctggggactgttgtggggtggggggaggggggaggggggagggacagcattaggagatatacctaatgctaaatgacgagttaatgggtgcagcacaccagcatggcacatgtatacatatgcaactaacctgcacattgtgcacatgtaacctaaaacttaaagtataataataataaaataaaataaaaaaaaggagtattgcatggtcagactgttcagatctcatgaatgctccctgcttctctattccttctttgatttgacatgtgccaggccatgtattccagtggatttctgtactttctactttattccaaaggctaagcattcctgaaagccacagagggagttgatgtgcttaaggaaagaagtatcgcttaatgtggccaaaaaccgattccatttctgtacaaatgcaaggagtttttgccaggagccagggattaatagtctagaggaagggactaattgtacacaggaacaatatttacttttataatgggaatagtttgagacagtgcatcttctagacacaaacattcagtaggaagggttatgcattaattctttcatttaatgagcattttaagcacctattatgtgccaaatatcttttcgtagctctacaacagtgttcacttctcaatcttttgctacaccagagcgttgggaccatgctcccattaatcaccctgtctcaaacaacatgctttaccttcattcgttgatttactcatccattccttctcatagtttttaacctcaagagctctgaggttcagggtggaataatatggagggcctttgagaggctaacttttgaaccaaatcttcgaggatgaactagggtagtggcaggtagaaaactgcctttatatttagccttctttggtacctggtcatggatttcttcttcaagcatgaatggcatcagttgtctgggagtgagatacagtgttcgtatgctgagaaacagattaggccattaaaaaaaaagttgtggccacgtgtggtggctcacgcctatagtcccagcactttgggaggccgaggcagggggatcacgaggtcaggagatcgagaccatcctggctaatatggcgaaaccccgtctctagtaaatatacaaaaaattagccaggtatggtggtgggcgcctgtagtcctagctactcgggaggctgaggcaggacaatcgcttgaacctgggaggcggagcttgcagtgagccgagatcgtgccactgctctccagcctgggtgacagagcaagactccgtctcaagaaaaaaaaaaaataagaaacttgtaactccctctctctacttgatgaagtagacatcaggaaagactttcttattctgctttccattaaaagccataacttggaaattattattgattgggcttggtgtggtggcttgcgcctgtaatcccagtgacttgggaggctgaggcaggaggattgcctaaggtcagaagttaaagaccagcctgggcaacatagtgagaccctgtctcaaaagaaaatttttttttaagtagcctagcatggtgatgcatacctgtagtcccaggtactggggaagctgaggtgggagaatcacttgagcccagcagttcaaggctgcagtgatctatgattacaccactgccctccagcctcggcaacagagcaaaacctcatctctaaaaaataaataaaataatatcttaggggaagttgacaaaacattagaaatattgtagggttaggtgcctgttgagccccaggatttattccattattcactcatatcttcatgtatccattcaataaatacttattaaaagcctacaccatgcaagataaaagccacattctactgagtatgcaatgatacacggtatggggtttctgctttatggaaactaaaggcctactagaggaattcaggaattccagtgtgtaccagctcggctgtaacacagtgaggaagagataggaaccatgaactaagcggtgaaaatgtgatgggattcagaggggtcagaggtattggatacagtgagattattttaaacgtttagggtgtacgagcaagatgagtaggagatttctttaggaaacatctccctatgaaataaaagtttatataaaaggaataataattacagttgatatttatgaatacttaatctgggccagggactatacttagtacttttcatgcattgtctgattaggtcctcacaacagccctgtaaggcaggtattgtactttcttatattttatagtttgcactattgtgtgctccatggttatagcaaaagctttgtctgtaaaaggccacagggatagaaggcagagaggaaagtagatgtgtgatgcagtattaattattgagccaataaaatctctctaatttagattttttaggaggaagtcattttacattttacattaatttaatctatattgagagatccttctaagaaaataagttgcattacttcaagtatacatagccatataaattattgaccaattttttttttccaattcatagacattactttccagaaactagataatgaccatttgttatcagcacactgactgcaaaatggatgatgaagaaagcctgggttttttttttttttttttgaaagcttggtagttcttcttgtgaataaattaaacactttcctgacgatcctgtttgcattattgacttatatgtactggctcatatgtagctgcccatgtataattctccccactcattctgaagggagggaaaaaaacgattaaaaatttcccctccttctttttcctgttttgagattatttttgctcccagcagaggcgcggaggagggagctctcagagccccattctgttccctacctacagcatgaaggatccagataaccgcagaatgaatgaggtttgagcatttgtttttgctataagtaagatggtttcccattaataaaagtggcactcagtttactttgtcttcgccagacaggcaaagggtaaattaaggtggttacctgtggtgtcccagctctttcccaaggctggactagtgtgagccgagaaccaggcaggactcactcacaggtccctttctctgctacttctgctctggttttatgcgaagccctatttcccagctgcttcgggtaaacaaggacttctgtgttgaaataataaccacttgggctgggcgcggtggctcacgcctgtaatcccagcactttgggaggccaaggagggtggagcatctgaggtcaggagttcgagaccatcctggccaacatggccaaaccccatctctcctaaaaatacaaaaaattagccgggcatggtggcaggtgccgtagttccagctactcgggaggctgaggcaggagaatctcttgaacccaggaggcagaggttgcagtgagccgagatcgcaccatttcactccagtctgggcgacagagtgagaccctgtctcaaaaaaaccaaaaacaaacaaacaaaaaaaccacttattgtttcactgcctaatattaattaattggccaaatttctattttattatattccatatattttaaaataatttcttcttctgttgtacaaaccaagatagaagataatttgcccaagaacacaattggtaggtatcctagctaggaaagtgggtgcttctgaaaattataaaaatgaaatgaggtaattttctgggcccttggtacaatgcctgagatgtcatatatactcagctaattataagtgacattttgttctagaatccagtagctcaacttttagtccattgtgctgaacacaaatctatagatccttaaattgtatacttttattaatttaattttaaagagccagaaaaattgactacattggaaacattccagtccaccaacatattgagtagaaagaaggacaaaggccatattctctttcagatgctacaaattgtgtatattttcagtaagctgtgtctgcttaaggaggcattactgcattcggatagataaactcaaataaaaaggcctgagtgaagaggctctactgggtttagcgtttttttgttgttgttgttcagttttgcatgtgtgtttttaaatcagtttatggttcataagctgatgaagcagtgagtacaagtttgaactatgagaagcaggtttgaataagtctagacatttggttatcttctgtctagcattcatttgtgtcgtgggcgtcacactctggggattagtgtttcattatgcagaagctgttttatctttagctttcttataatagcttaaagtgaattctgagtggagagagaatgaaggccaggccttagtaactgcaagaatcataccaaaatgggttggatgggttttaacagtgaccgataagcattacgacctcactctctgatagttcagttggctcgatgctgtctcatcacctcatttagggtacaatatgctgaggaactgaccaaaggtccctgaacagtgagagatagggaagagcagaaatccgttcctgtaccaagtgtctaacacttaatataggtgagagctggcgtgagattatctgtgctgtggaaaaatgaggacctatcgatacctctaagtatataatcactgccgtgtcacattttaattagctccttgaggctatagaaagaagttcgcttcttatcctccaaattaagcatcacttttacaaacaatcaatgttccattttcaaaaccccaagtagagcaatgtttgattttccttactttccagctttgagaatgtttcatttttagaaatatgttataggaatgtaaagtaactcttgtttccccaaataaccacctccttattatctgttcccctaagctgaatcctttcaaaggaaattttgtcttcaggctaagtttagtggctgatggaaatcaaaattatatcaggtgggccattgcgtcagtaaaaaagcccagaccaccaccacacaggatttttctccagacacccaaacatcatgtcacaaagctcaaaaaagtagtgattaacatgcagtgctttcaggaggcccacattgccgattcagtcccagtatgggctcgtcagtttcactttcattcattcatttatttatttattcccccacccattgattcacattcactcatccattcattaaacatttgctgcacacaatatcactgttagacagactttcagaaatgattgggttcctgtattacagacatgagcccacggcacaaaggtcaaactaagagtaagatggatgtttatagcacaagcctataacaaaaagaatgggtcccgagccgcatcttcttccaaatgcacaaactatatttgtaccttaaaaaaaaaacaaaaacagtgtttccttttgagaggcagcatggtatatgggaagaacacggatttaagaactagacaggcctgggtttgaattctgcatccataatgtgctaactgtatcatttcgaggaagttcttttgagtttcagtttgtctttaaatagagtcatcatttctactttgtagggttgtgtgaggattaaatataaaatatgcagcataatgactggcacatttaaacgaagtgctcagcaagtgctatttcccttcccctttcttcatttctaacatagtttgggaatggtttaggatgactctttttcttcttgtgaatagatagagacctcatcaccctaacactagaaaactataggacagagaccatacttcttgctgtggccagccctcatccactttgatgatgcttgcagctcccaagagagacaacagcccccacggcatggccaagagaggagcaaactctctccccaaggcagtcactctggggatgccattgttccattgccaaactcatgacctttggggaatttggaaatctactactttgtggggagaaaaggacaaagaaagtcaagattaagctttatatgtaaaggccttttattttaatggtgttgaattgagtttggattttgcgtacccttcaaatttcttagggtgtgggtgagggcatcctaggagatttaattagctccttgagcggcactgaagtttgcgacattgaggcacattttcttctattgtccattgaagtgggggagcctggcaatgaaatttctgagaaactgacgctgttgccgtggatagaattgtatggatatttgaatttagtttagtcacttggtggagttttattttgttgtttggtttcttttggaaagagaaaattagtatagtatgaatctgagcagtctggttacatgctttaatgggcctctgagataaagcagaaaaggatgtagtctagtagtaaccctttagatgataagggacacgcaggaggctgtccaagacagtctgttaatcttaatagtctctcacttgttaagacctgatttatttcaaactaaatttcttgttttgagtttccgggtgaaagttctggactgaatccctaaaaacatgcacaacaaagaagaaggcttttagaaaggtttctcctattgacagggttcatattctatagttcacaattcagtgaatcaacatttatattaatttcatccgttacaacctcagaatttgcctacaagatccaatggcatttttactgcccttatttagcaagcctatacagtacttcatgcacttggtcatgtcttcaactaatatttattgggtgtcttccctaagcaagatagtgcgagagagagagctgagttaaaacattcaagataacctcaagaagctgacaatctactaagggagataagacatacatattaataagaacaacttaaacacaaaggacaagatgatatgtggcatatcttatcaattaaataatgttggacttcagagggtgaaggaattaggcatgaaggtatatctcaacagggctgtgaatgactggaaacaaggtcttctctcttcacactgtgagccagccacatccatactacggtgacattcatttctcccccaggccagctatgggcagaagtttaattatccttgaacgtcttcaatgatcctcatctttgcccttgttccctctttatcctttctttctccccaatgtcttaaatcctgatgcagccagggagattttttttttttaaccttcaagaaggtaaaaaactatgccagggcaaaatgccagatcaatgttgctattaatataatcagatataaactttttccagttggcaccaacaaccctgggccttctctgagtaccacctataaacagggcttcaatttcccatttttgcatacttactaatgtactacagatcttgcactgactttaattcaatatcaatattaaagtcatatgaggtagtagtaaatagagatagccataccttagagtcaataagacataaaattagttatgttattattattattaattatgcataatatgtcattttcctgaagagaacagactaatagctgatttcagcaagcatctttaggcttttgttttcaaattattttacatctttttcttttcttttcttttcttttttttttttttttttttgacacagaggtctcactctgtcacccaggctggagtgccgtggtgtgatctcagctcactgcaacctccgcctcccaggttcaagcaattctcctgcctcagcctcccaagtagctgaaactacaggcatgtgctactacacacggctaatttttgtatttttggtagagacgtggtttcagcatgttggccaggatggtctcaaactcctggcctcaagtgatccgcctgcattggcctcccaaagagctgggattacaggcgtgagccactgtgcctggccacccacctattttccatctttagcactggccgttctcattcaaaatacgtactgctacactaagaggagacttaacttcaaattcactttgctccacggatgttgtatatgacctgaatagatgtaattctgacaagcttgtagttcattggaggctcacaatttgaaagaaatgcatgattaagactttagaacataaagaagattctagtaaaacaaatgattgcacccttttggattttttgcatattatctttatgtagggaagggaatgatatgttagaaagaatcctcaaacaggtttagacaaatcactggttgaaccataatctccaaaatatcgctacatcagaaaaagcccaacatagcctctgaggtattcgtcagaaatcccagtgcaagcattaggaaagaaatgtactccctgctcctcacctttgtaagtcagatttagtcttcactgttcatttcaggttctctgcctccataggggtcccttcagcacttgtttggttctctaattggcttatgatagtgggtcttacatcatcaactggattgtaaattccttcagaaagagatgtcaattaagtacacagcagagtcacagtatttcaaaattggaagtcatagtaagggggaaggagggccgctagatgctgtgattcacacggcgtcatagtaagcaagaggccgaggcagtgccagcacccaggtagggctccggtgccaccctctgcttcatcctctgccaagcctatcacgacggtcgttcagctcatgctctccatgcacgtctggtgatttgatgctcatctttgccagcttcagagcatcactggacacatgcccagtcttgaagggttaattttcaagtaccaagcatgctttggacaaactcaaatctgttccttgttttcgctcaacccgcaaccagcatcatcagcccagacgcagcttccccagaaggccagcaggtggagcacagttttgtggaacttctctagaactcgctgtttaaaagccgcaaaccaagacatgtgaggctgtggggtggggggcaaagaagagccccagattctgcacgtctggaagcttttaaaattgtcttacaacaattttagacctacaaaagccagcttttgaaattgcataaacggcaagtcgagttcttttttttttttttttttgagacctagtcttactctattgcccaggctggaatgcagtggcacgatcttagctcactgtagcctccacctcccaggttcaagctattcccctgcctcagcctcccgagtagctgagactacaggcgtgagccaccacgccaggttaatttttgtatttttagtagagacagtgtttcactatgttggccaggctggtcttgaactcctgaccttaagtgatccacctgcctctgcctcccaaagtgctttgattagaggcatgagccacggtgcctggccagcaagtcaaatttttaattagacttaaaatgttggtgctcataacaactacagttactgtggttttttttttttagtttcataaagaggacagacgctaaggcaattgtgtggaacagagcagcttctcggggtaaccatctcctgctgatgtataaatatcggggcaaaactgagtaagttttagaaaataaatgtcaaagcaagtccgagtcatttattccttagcaggaaatatcgatcctgtgacattatttgattataatgactgtttctattaggttaaatgactgaggtatacttaaccagtttaggtgaagaatgaggctcattgcaccatttgattgactaaaccttagaacccatgtattctttttatttgttcagtcaccaatttttatgaagcacctactgtgtgccaaacaccctcttgggtgccaaggtaagaattaaattttggaattaagcaaagcatgatggctcatccatgtagtcccagctactcagcagactgagacaggaggatcgcttgaacccaggagattgaggctgcagtgagctaagaacatgccactaccctccagcctggatgacagagacctcaactctaaaaaacaggttttttaaaattggaattaaacacacttgggttcaagttctacttcagctacttattagttgtgagaaaataaatgtcaaatgtttttcaatttgcataagttatttaaccacattatccttactttccttatcattaaaaccctgaaaaggttgtaagtgacaaaatacgtgatacacacttagtgcctgtcagatgataggcctgagttactgttaacttttttttttttttttaccatcctcatcatgttcctcattctcatcttcttccagggttctcacttgatgaaggaaagtatttaagacaatacttctttaacatacttaataatggaatggatatagaaatgggagaaatcagtgtgaaagcaggctttggtgaggccactatttaaaataactatagtttatttaaaggagacacgaagtaactgagatttcacaaggccccagacccccttctcgaatgttattatcaactcccgtttctgccctgtgatgtcatgagggttgatgatcggttcttcttttattttgttgccaagtacagcagggatatgtgtcctctctattcctgagtggtgaaagttctcttctgagaccacaaaacatggtggcctcaggttctttatggccccacggtctcttcctgcacccctccccaaggggctgggttggtagatattcctaatgttatatcccctgttgttgacacccccatgcccccaatcccgcatgcctagcagatgcaccttaacccaaccactctgggtcagttccttcctcacacagcaagctgctaagaaggttgaagaattactggacttcagataccacatggcaccattatccctggcaggtttcctgtcactgcctgtttctttttcttccaggaggctcatcaaacaggcctccacacaaacagaacatccatccacttcacaggccacccagacgtatccagagatgcccagatgagacctgatttgcctgggttaaccgtgtgtctgcagctcagaccctccaatggggcttctagctacatagtctaatgatgaaaagctactggcctgggatttaagagcacagctttctagcctaactccacaactgtgcccctgggaattttagtctcctctctgcatttcaacttcaccaactaaataagtaccttttaatatctaattgaattgatatgctatataagcaaaccagatgttgtgagtaaaaccagcttcagcatccaaaagttgatacagatacttttgaggagcatgtttcaacatattccttaggacagccttactatgagaaggtcatctctcagtgatttcaatgtgccattggaagaagagcttctgccatttaaatgtccagttaggcactggtggacacagcagtatccttcccattcattccgaccatattattttgaatcataaaggcatatccttagaggagaacatttaaaaaatttaataatgtatttgtttcattaacatgaagttaagactttaagataagggtagtgcccacaacacaatcttttaaaatgaagccaagttaacagtcattactctgtgatctcaggcatgcccattatctctctgagctataacttcctcatggatgatcactagtctcctgccgctgtgaacttttacaaatctgattccatagtacacatcttaagtgttagaaatgcttgttctttggtgctgtaaagaaatagaccttgaacataaatttaatttcctcagcaagaccatttttactttctgcagaaagggtacacttgccagcagttttgccacaagagtacacggaacaaaggagacagggtcattataacctgacgcgtccaccctactgctatgtccagtttccattggctggaatgggacctcacattctgtatttgtcccgaatggctagcagcttagaactttttaaaagcagcaaaagcagaagagaacaaaggaaggaggaagtaacttgtgaaatgctgagaaaggtaaaaaaccttcaaataaggaagaggaacaggctatgacctaatgcttgcttggaccagtataagcatgctagggtaaatatttaggctaaattgtgggagctaagaacataaagtacattgatttctttattacagctagcagatatttaagaatgttagcacaggtctttgaataaattttgcttctaagagaaagtactattaattcctaattagatggggaggaaaatctttgaagaggaacctctactttactttttacattaaggaaatagggtgtctagtaatgccctcaaaagttatgaatgcccggtatccgttaggtttgaactaactgatcttcacattactttaaaaatagagatgactcaattattggttggctgtgagtaaaaccaaataaagctttatttaaagttttatttagattcttgaaaaaattatttaacttgggttctccttggtatgattaatttagagagaaaggaatctgagaatgctgttgacctcatcattccttcacatgttccacttttttagtctctcattttaacttaatgaaggaaagtcatagggagaaaaaagagagagaaaagaagataaggctgtgaagagagagggttgttttaagacctcacgttgaacaatcagctaaatctgcattgaaagcaagagaaatagctcaaacacaggtttatagtattttctttctgagagtgaacattgtgcagtaaaaggtccttcacatgctatggttcatacactggcatttcatgaagcagtagggagcagagttaaccccaccaagagcactgcagtgcggccttccttcccagcccccgttccagcacctctttccatttcccgacttttctttcaccgccagtaaatttaatgtcttcagctgagcactgatttcatgagcgtaaaggacattagcagtacttcgcacatggtatgcacaaatattaggcaagtccaaggacaggatgagctgcaagcagtctatgataagagtcaaaggcaggagttggggttgtagactcctccagccaaccacagcaaccaggaatttggatgcttcggccgccagagtgcttgcaagagttcatctctgaaatcgcttccattccagcgctaacattttatgaaacctgtgcttttcaaacagattgttttattgcttcctgcatcaccaatgtgttttctctttgctcccagctccctgagagcattttgaattatagcacagatcattgccatccacaaggtgcatgacatcacagtggacttgggggaagcaatgtcaaatgagactgagtggaatgggaaggagataggctggaaaatttaaataaaggtctttaggataaaatacagaatccagaatagttcctaactctcactacgtagtcgtttgtagcaaactgctaggactcttggcttttattggtgtgatatagatgcgctgctccttaatggtagagactgtgtctttaatcaaaagttggctacagagttgtttgtgcctgtgatatacttattagtccagagcagatatattttctgtcgtgtgtgctgaggagcactgatgtaaatccacttaatgttcatatcaaactctattctccaggaaaaggtgagggactgaaatgtacatacttgttggctggtcacatttgatattcagagacccaaatgagaaagtcttgcttctgagaaagtacccaaacaccaggacatcttccaagccccacacagtagcattaatgttttaggtgtgcaataaatagtgctgaatgaaggaagaaagtttcccaggctagaaacaggtgagtggagacgtgattattattaatacaaaatctggtgtgaggtgggggtgggaccctctccccaggctgtaccgacagccccttgctctcagtcggactcccaggctgagatccggccactaaagagggaacagtgacatttcacaggaaatgacccagaaaactaacaacgtggagtgtgtgtgcgtgtgtgcgcgcgcgcgagtgcgcgtgcatgtgcgtatggtgcacatgtggtgggggctggggacagcttgaatacaacccagggaccttaactggaggaaagactttaccaggcagactctggtaaaagtcgagcaggaagctgagcgtgacaggaaccccaagggtgtcaaaatgccccctcactcagcatctcttgagtcccatcaggacagaacttgtgcttagtcaggttctggacctgacagatgtgaaccagacgccctctcattgctgggggctctgggagggaaaggtgggatgaagagggcacattcctcccaaaggacaaagcaccttttagtggaaaatgtgaaaacaaaacatgctcagttcaaacaaggctcactttggtccagtacttcctttgttatgttcctgcctcttaaatctttctgctttaaagaactctccaagaaaatattttcagagtatacttttcagaggccctgtggaagccaagaataaatggcctccttttttgggtaaagagtcatatgtttaagatagttttatttgctccccccacctcctgccccgcatgcacacacgttgatatggttaactatcttctgctctgaatcagtattaagaatgggcacagagatgactaaaagccagaatttaccatattatcccacaaagcagtaacttttcaattttaggatacataatttcagcatttttcctatcactagatgtttagagctccctccagtgtctctatattgtcatatttactttgagatttttttttttcccaaagatcctaagaattcttttaaccatagcagggagagtatgttattgtctttaagcttacttcaagaacagaacgtgaaagccagaaatatcacatgcagccccacaacctatagattgtccattcctgctgtctgtgctttttttcaggatgaggagagttttggaggtagaagaagatgaagtggtcagaggatgggactcaggaggggacagggtaataaatatggtatgaaagttgctgcatttaaagagcttagggccgggcgccatggctcacgcctgtaatcctagcacttttggaggccaaggtgtgaggatcacttgagctcaagagttcgagaccagcctggccaatgtggcgaaaccccatctctactaaaaatacaaaaattagtcaggtgtattggcatgcatctgtagtcccaactacttaaggggctgaagcaggagaattgcttgaacccagaaggtcaaggctgaagtgagctgagattacaccactgcactccaacctgagtgacaaagtgagaccctgtcttaaaaaatttttttttaaagagcttgaataacttcctcttcttagaaaacgcataaactctgatgtgtcagctgagaagccgaggacctgggatttcaacctcttgcccgtgtgtttgtgattctggcgtgaaggtgatgatgcatttccaaagttgaacttggtctgctaggtttgggatgtggcagaattctggttcctgccagagtcccagtctttctgagtgtatgtgtgtgtacatgtgtgtgcatgtgtgacgtatgtatttatatccatacatacatacacgtgcacatctacatgtgtatgtatatataatcaagatgttcaaaattcaaagcgctgttttaagagagttaaaaaaaattcactatctacagatttgaattcagactgggttaaaaccaccttcctcctctggttgtcaagaggaaggttttggagttcgtgaattttttctgtggagttaagataacgtttgatgtaggagagcaaagctgcttcccatgcctaattccataaaaagcccagaacctctgaggcccatcttcagccaagcagccttgccctctggccttttctgcaacagtgagacaacagccctgggcacagcgggagttggttctgacaccagatgttctctgctcctggttaatgtcagtgagggctggaagttgaataaatgagaacaggagtggtctgggcccatgtaaatgatcctcccttgaaaggaggaacagctttcatcatttgttccagctaagccttgcatgcattatagatctggtgctaagcagtgggaaagatctcataagtaatgttttatgttctttctgtctctcctcttctgttgttcttggcttgtgggttgtgttcgtgttgttaactggaaaattgctataagccagttgtctcgtaagttttaaaaacgaattagaaaaaccataaaatcctctggcctatgcacattgtccctgttttgtgaaaacattaaagggtaaataaaaaggaaggagaacagtcaataatgtgcatcaaatatattctgagttctagagaaattaatgaccaagcattagaactagaagcaaaaaaaaaaaaaaaaaaaaaaaaaaaaaaaaaaaaaactgtcagtggttggcgagaagtcttgttttttccagccatatagatcaactgatgatatggtttggctgtgtccctgcccagatttcatcttgacctcccatgtgtgtgggagggacctggtgggaggtattgaatcatggggggcaggtctttcccatgctgttctcgtggtaatggataagtctcacgagatctgatggttttaaaaagaggcattcccctgcataagctctctctcattttttgcctgccaccatccatgtaagatgtgacttgctcctccttgccttccaccatgattgagaggcttcctcagccatgtggaactgtaagtccaattaaacctctttcttttgtaaattgctcagtctcgggtatgtctttatcaacagcataaaaatggactaatacgactggtggttgagaaaatgtagcagcctgagatttaagaaacaagtgatccctgagacagagcccttgaccctaaaggggaaaaatattcagttacactcatgagatataaacatagtacttttgttgtaactgctgagaactgaagagctaaaagtcaacattattttcctttttgagactcaaagtgtgtccaccaggagcactcttcccaatggaggcaaaatctgccaaagttgtttttgttgctgtctaaccttagaccatttcatctgccccaactaaaagtcctagccacagctctctcaagcgattctccaccctcagcctctgagtagctgggactgcaggcacatgtaccacacccagctattttttttaaatttttaaattatgttttttagagtcaagggtctcaccttgtttctccggctgatcttgacctcctggtgtcaagtgatcctcctgcctcagcttcccaaaacaccaggattacaggtgtgagcctggtcccccaggcttgacttggcacattgaatcttttatgaagaacaattaatgacttcccatgttgtgtaaagagacgggcaaatgtggcttcaaagcaagtcttgccaaccctcgctacaaccagactgtccctggcctaagcaagcccctcccatgtagacctggaaagccacttccaggtttcaaggatgagttttagaaaattaatggggtactagcatatgtgggtcaactctttattttaatgtaaggacactggacactttaaaataagttttctaatctttttaaaaaggaagggatattttaacatccccaaagtgaaaataatataatatcagagtaagtcctagaaatttaatattatggtacatttactatgttgtctttatttttcttcatttccacggattggccctggttctcagaccagcatgtgggaactactgggttggagtgttagccaataaaaatggccaaaaagtagaccatgaccttctttgagcttttctctggcttgtaattcccgaagctccttctagtgccaaaatacttctccctccctccctcttttagactgtaagctcattgagaacaaggacaatatggtaatcttaatatctttagcacacagtcagatatgaaagagacacatcataaatattggattaacaaatgaatgttctgaaggggaatgtggttgttgccactgtagaaaaggttcaggaaccaggaattcttgtgtaagatgtcatccacatagtcactggagaattccacagttgggttgagggcaaataggaatgccatgatccaggtacctagaactggcttgaaaacttgtaccttgcaacaataaatggaagccaatggccatgtggtctggccatggccacgtggtcagaagagaaggaattttcgaatgaggatagaggaagtagccacggagccctgaacaggggcttgggaggttgagctctctccacctcagagggctgtaggagaaacagggctgtctgcagggagccaaggttacagtctgggttggagagaatgttctgaggaaaggctgaagcaagaagagagctactttttactagattactgtgtattcagagggcagagtggaaataattaatactgagtgaatagaaggacagacagacctaaggataggtgagagaggtctgtctggtgcttctgaaagtttcaagtgtctaggaagcccccagcgttctagtggaaatgcacattctggttctgtcagtctgggtgggacctgagattctgcatttcccacatgctccctagtgatgctgatgctgctgggctgtgggccatggtgaggctagcgtttaggtcaaggaaacaagcatcttcagaggatgtcctccaggagcccaggcaacagttagaaggtcaatggaaaattctctggctgcagctgatcttttctgcttccctttagagcagggaatctcaacagcactgttgacatttggggcccagatcatcctatttggggaagcagggagatggagggggtggaggtgtcccgtgcattgggagaaatttagcagcattcctggcctctatgcgctggatgctggtagcacccggcagttgtgacaatcaaaaatgtcctcagacacttccaggtgtcccttgcagagcaaaattgcttccggttgagagccagagggttagaaggagaattatgtgtcttccctccccgcttgctgccacctccacctcttgtcttctagaaccatgaggcagaaatgacttaagtctgatatgcttggaacgcaacactcttttcgctatttctgtctttagaaatgttgagaaagtgtttgcctttatttgacggcctgattactttaaggtgtcctcggcatagaccagtgagcgccttggccctatttgctgacagttttaatagaacagcagggaaagtcctttccaagaaagtgttggctacgtagcctaacgtcattttaagtcatcaccatacacccaccaaacctctgagataaaatggaaactccatcatctcttgccagggtaatggtgttagtaattcactagtgacctctaagaatttctctgtgcattcactgccacatttaacttttgttacacggcctccaaaatgttttccagccacaaggtcagtccattgacaatctcaaaaatcctgacaaggggacagatgggtttagtttttgcctttgtgatggttagttctgcttaatgtgttgagaaaacatctgaaggttttaaccctggctggagtcgtgagacggaggcatgtttaatggaatagcacacgatcgtcctctcatggtgagtccacgttggagggcccaaagacccatgttgtacaatcggttcaactttttctgaaagccaaagaaaacctacctccaaacaggatttagtctcaagctagagcaaaaatgtacatcatgttgaaaagtcttctccaagtgctacaattcataagcagtgttgtgtttttactggaaaagcttgccatctagccaagcattcttcacatttttcccaggatttagtcataaaatcattttagacatattgcaaggataaaatgtgtacatatctgataaaaggcagggatttttttcttcttttttgctgtataactcctggaggaggcgaaaaacaaactagacacacacatacacactcacaaaacacacgtatttgtgcatatgtatgtgtatatagagagtgcacacatgttcatatatatacgtgtatatgtgtatgtatatagtttgttttccccctcatgaaatgtgtgtgtgtgtaaaataaactctatacacatatacatatatattattttcaccattaagtgcaagaacttggattctttattcacgattacttctatttgaatttaaattagatgccttaggcttctctttgggtttgaataacttagacacaaagtataaaacacttcctaatgatgcccacctgcctaggacatctttaggaattcaggtggaagtgtgtttgcatttgatttatctaagacgttgcagcagtggggatgtaatttctgcctttgggcaggaagggagcttagatggtggagttcgtatttgtaaacgtagatgtgggtgcctcaaagttggctgcgttgctaactaaaggaaggagagaagtgagcccagatgttgaccttttgaaaaaaaagtcccattttcatgacagattggcataaaagcaataacctgtggtaaagtctaaagaatacaagatttggatttctggatttgagtcctgtctatgcaacttactagatatgtggccttggacagatcacctaatctcacctgtcaaacagggacaatgaaactcaacatagcaatggttgcgaggagttaatgaggtaatccgtcaaattctgtggccgtggtgaaggatgatacaaatatccagtggcgtttttgttcttgaagatagtattcttgtgtgagttcttgccaacacacatacaattacatttctgagtcagactgatttcagtagcagataaacagagggagtaaatcagcaatagattagttggaaactctggacagcaatgatttggtggcatatggcttggtggtatgtacctgcacatgtaatcatggaaagttgactattcctactgttctcccctagttctatttcacttaagaaaaagttggaatggataccagcagtgtgctgataaaagtttagctactactggcggccgggcacagtggcactttgagaggctgaggcaggcagatcacctgaggtcaggagtttgagaccagcctggccaacatagtgaaaccccatctctactaaaaatataaatactagccgggcatggtggtgggcacctgtaattccagctactcgggaggctgaagcaggagaatcacttggaggtggaggttgcagtgagccaagatcgtgccattgcactccagcctggatgacagaacgagacttcatctcaaaaaaacaaaaaacaaaaaaacaaaaaacaaaacaaaaagtttagctactggctcgggaataacaggacgtttgatttgtagcatttactgatttctgtaatataaatactctcactgtgactaatttcaaactaccaatgtgacattaccaaccatgagattgtaaagagatgcacagtagcacaccaccatataggacagtcgtgcatcacttaataatgggaatgcattctgagaaatgcatccttacatcgtccttctgcaaatatcataaagtgtgttcacccaagcctagatggtacagcctgctacacatctaagctatataatgcagcctgttgctcctaggatacaaacttggacatagggttacgattgcctacagcactcagcaccttactgtactgaatactgtaggcacttgtaacacaatgttcctaaacatagtttttgtgcatctagacatagaataggtacagtaaaaatgaagtagaaaagattttaaaagggcacacctatatagggcacttaccatgaatggagcttgcaggactggaagttgctctgggtgagtcagtgagtgggtggtgagtgaatgtgaaggcctaggacatcactgtatcactgtaccccactgtagactttataaggactgtacacttaggctacactaagtttgttttttaaattgttctttctttgataataaattaaccacgctcagcttacttttttactttataaactttttaatttttaaaaactttttgataactttcataatagcactcagtttaaaatacaaacacattttacagctgtacaagaatattttctttctttatatctttattctataagcttgtttttgtagaaactaagtctcactatgttgcccaggctggtttcgcgcacccgggctcaagccatcctcctgcctcagcctcccaaaatgctgggattacaggtgtacaccaccacatccagtttataagctttttcttattaaaaaaagttttttttttttaagttttctgttaaaaactaagacacaaacacatacattagcctagccccacacagggtcatgatggtcagtatcactgtcttctacctccttatcttttccatctgtaaggtcttcagaggcaataccatgaatggagccatcatctgcgatgataacaatgccttcttcttgaacacctccagagggacctgcctgaggctgtttacagttaattggcttttttttttttttttttttttttttgagacggagtctcgctctgtcaccaggctggagtgcagtggcacaatctcagctcactgcaacctccgactccctggttcaagtgattcttctgcctcagccacccgaagagctgagattacaggcacgtgccactatgcccagctaatttttgtatttttagtagagatgggtttcaccatgttggccaggatggtctcgatctcctgacctcgtgatctgcccaccttggcctcccaaagtgctgggattacaggcatgagccactgcgcccggcctacagttaatttcttataggtagaaagagtccactctcaaataacaataaaaagtatagtatcgtaaatacacaaaccagtaacatagtcatttattttcactatcaactattatgtactgtgcgtaattgcatgtgctatacttttataggactggcactgcaggacgtttatatataccagcatcaccacaaacatatgagtaatgtattacactattacattggacagctacagcatcagtaggcagtagaaaattttcagctccattataatcttatgtgaccgctgtcacatatgcaatccgcggctgacccaaatgttgttatgtggtgcatgactttatatccactatacaagtagatgtaattaacctcagtcatacagataatagtaaaatagagtaaaatgagggatgatgatgagtttttgtttttgttcttgtttttttttttttttttttttgagacggagtttcgctcttgttggccaggctggaatgcaatggcgcaatcttggctcaccgcaacctccacctcccgggttcaagtgattctcctgcctcagcctcctgagtagtgtgattacaggcatgagccaccatgcccagctaattttgtatttttagtagagacgggatttctccatgttggtccgactggtctcgaactccccgatctcgggtgatccgcctcgcctcaggagtttttaatataatttattaaaccataagtttatataagttaatttttaacattggctatgttgaacgcttggctgtcaagcttaactgttagctctcacagacctggctccaacatgctactgtttctccttggctgtgttacagtacaaagttataccatgaattagcaagttcaggaccatcctggaaagccagcgtggaaaatgcagtcataaatggatttttatttctgtggactttggactggctgtctactcttggtctcacattctctactgcatatctctttggctaagaaaattagtattgaaaaatggtttatggatctagttattggagctagtattcaactttttagttacttaaaagataggacttaaacagagctgaattttatagggtcttttattttcttctttggtccttaagagaagactgcagaaaactagacaagaggaatttgaatgttctcataacaaagaactgataaaggtttgaagtgaaaaatatgctaattaccgtgaattgatcattacacaatatatacatgtattgaaacatcatactctagcccataaatataagaaattatcagatgtcaattaacaatggaataaaatgaaattaaattttaaaatgaaaacattctagaaaatattcccaagaagagatttatttatttatttttctggctatctatccttaagggttcgggaaaaaatggccggtggagaacaaaagattgaaattttagctcattcatgatgcacgtgaccgggaaggagtgttaagatgtcctgtacttccttccataatcacaggttgaggtgagggttgcctaaagtctgatcagccacattttgacagtggagactcagaggcctagttaggaacacagaaggaaaaatgttaaaggcagacctttataaccaaaacaatcaacaggtctaaaagccaaagaaaccagtatttcagaattgttaacttactcctagatgtgtgttaggcatcgggcttatcttaaagaagtgtcttagaccacagaaacatagacccatgatatttggaccaagcataggttaaaactaggggagggaggcacgaattacaaaaaaaaaaaaaaaaaggtgattccatgttagaatcccatgttgaaaaggtattacactttattgtaatacagacaagatttcactgtgttggccagactggtcttgaactcctgacctcgtgatcctcccaccttggcctcccaaagtgctgggattacaggtgtgagccactgcgtctggcctaaaaagcatattttaaaattagtcacatatggaagctaagtagtgcattttgtgtttccgaacaggacttaaaacgtcagtgccataaacactggtatgtattcagacacactggtcatatgtcatgaatttggtagacatatttgtaggcaaataatgtagagatagagtcacatattttaaactaaacaactcactatgaaccatcatgatggttcacacctacaattccaacactttggaaggccaaggtaggaagatcacttgaggtcaggaattcaagaccggcctgggcaaaaaagcaaaactcctctctacaaaaaaatttaaaaattagccgggtatggttgtacatctctgtagtcttagctactcaggaggctgatgtgggaggattgcttgagcccaggagtttgaggctgcagtgagctatggatgtaacccagaaagaccctgtctctaaaaaaaataaatatatacaataaaataaaaataaattaaaaatttaaaaagccactgtgattcttctctgtgatcattcgtaagtcatacactattttgtgtgggtgaaacatgtgatctgttagtgggtctgagaaaatcatatttattaagcaaaaaagtcaatatgtgcttgtgttttgcttatgaatttactcgaataaaatgtctgaaggtcttgaaacttcttaaaagaaaatggttcttacttcattttggtgtgtttacattaaggggagccatgtgacctcttatgagagttactgtcaaatttcaagtgcatgggcattgcctggaggacttgttcaaacacagattgctggaaagcccaagaatttgcatttgtaacaagtttacaggtgatcatgatgccgctttccctgggtgactcactttgagaaccactgtcttgtgagtttagagataaagaatggttgaggtcgtgtgcgatggctcatgcctctagtcctagcactttgggaggccaaagcgggtggatcacctgaggtcaggagttcgagaccagcctgcctaacatgatgaaaccctgtctctactaaaaatacaaaaattagccaggtgtggtggcgggcgcctgtaatcccagctactcaggaggctgaggcaggagaatcgcttgaacctagaaggcggaggttgcagggagccaagattacaccgcttcactccaacctgggctatagagcaaaactccatctcaaaaaaaaaaaagaatgggttggaaaaaatgtctgcacatcagtaagcacaaaataaccattgataaatagcattacaagcatccaggatcctaacaggaggggagaaaatcaggccactttagaaacacttttatgactggcagttatccagtttgctactaaggtcaggtctaaaagattgttaagactagcctgtttctgtatccatgggtatcagctggggaagccaagttctgtctttgtgcttggcagccctccccaatgccatgtctctgctgatgacattggaatttcctccaaattaaacagcctgacagcagccatctgtaaagaaggcagcaaggttacgagtgatcactggctagtgccatttctgctgccaaccaggcaggcaaagcttctggcatgttcttgaccacctctgagaagagttgatgtttcctttggggtatcatagagtttctgccacccagctctgtttctctgcctcctggtgcctgcccctaattattgcatagttgtcactgatcctggtaacctgactgctggatttttgctccagaaacctacagtaaaggagaccgtaggccaccagaagccaggaggaaacatcaggctgcagtcaagggcactgccttctcccctccaggctgctgggctttgagggcagagaaataaaaagactgaaagggattagaggcctggagtccacaacaaagccctgtagtcatccaccaccttgcacagcctcttcctgccatgcttacaggtgaaaagtctagttcataggacacattgcttttccagaaccttccgctgccttccagagccagcattcttcctgaaaactctctcttgccagttgtttgccttcagagttacagtttaaaaaccaacacttaaactgatatcctctgaagaaaaaaacagataacaaattcatgaatcatagttatacttaaatttcctccgtcacagagaaacatgttatttttagaaagtggatcccaaacctaactgatcagaatcccttgggggaaatgtttttaaaaaataccattacctgtgcactggcccagaaaatccagggccattagagactgcaaatgtctgagaatctgtgtttcctaaaaggcacaatggtgattctgatgggcagccatgtttgagaacctctgattgaattgtgcacaattttgatggtgctgctgttgcattataggtaattcaaagaagagcttcttttttttaaaaaaaaatagtaatctataaatataatagttttcatctgaatagtgttttcttgttttcagaagaccttcataactttttttttttttttttttttttgagatggagtcttgctgtgtcacccaggctggagtgcagtgacgcaatctcggctcactgcaacctccgcctcccaggttcatgtgattctcctgcctcagcctcctgattagctgggattacagacgtgtgctcctacgcccagctaattttttatatttttagtagagatggggtttatccatgttgtccaggctgatctcaaactcccaacctcagatggttcacctgcctcggcctcccaaagtggtgggattacaggcgtgagccaccacgcctggccataactattatctttgacaattttcctgggaggtggatgacaggacctgttactgacgccagtttacatctgagatgctgcagtggagaggaattggaactagaaccgacacttacggcttcttgtctggtgtactctctgctgttccatcttcattgcttgtgtgcatgcgtgtgtgtgtgtgtgtgtgtgtgtgtgatgtgtttatttgactccttgaatctatgttgtcttgtttttcgtaaatggattaacgccactaccacggatcatcagggagatatgacgctagagatagataagccaaatggaggtagaaaatccaaactgaaaacagggagagaagctaagatagacccaaggagtctaacaacccaagttctaaactagagagaaggccactgttcatctatttcagggatgggcagttatggaaatagtatgaactcaggcatcccaaaggcagtgcagtgtatgagagaaagatgcttgcatgcatactcccagcaaagctctcagtggggcccaagatgcagggcatggagggtaataaagattagccaggaaggtgataggacaacagatactgaaaacatggcaatgaaaaaacatcagcattcagaggtgagaattaccattgccagaagttcttgggaagtaaaacaagtacagagctatgggtcaaggatctcacagttagagtactagtagcagtagggtggacttgagtctgtagtttgggaccagctgctaacttaaagcctgggaagctcgtgttagccagacattacagatactttttatgtcaccttgaacaagcttcactatccttatatttaaaataaggagtaggcctattaataatctgtatgtatttcttgcagtaaggaaatctaattttgggaaatgaatagcaagaacatagcttggtgcagtgagtcagtgagaggatttacaaaaggtgaacgtacacaggactcttaatactgatcctgggctagtcatgtcattgcacatgacacctgctgttggaaggaacaggttaagcatttagttgtgtgcaatgaacctgtgagccctgtgggctggtcccacttatttgaaatagaacgattgcagtgcctatgtgagtcagggtacacctgaatgtttagttagtgctttccattaacccttttcaattttgcttctatgttttcttttcctccagaaggaaaatgagcagaaggtgtgtcacatgctcgctttttatctgctgcgtagttcttgtagtgaaaggattgtcgataagttcagaaaccaagactactgctgcctccccttcattcattcagtagtcttacagcctaaagaagacaagaaaattaaggactctcaaggcaaaaggaagtcaaatgaaattgggaagtgggtctacagtaaatgcaatatctgtcgctttcttttagaactgcataaaccacatggaaattttccgtgtatatttgctaccaagggatgctatcatctttttctttccttttttttttttctttttttttggagatggagtctcgctctgtcactcaggctggagtgcagtggcgccatctccactcactacaacctccgcctcccgggttcaagcgattctcctgcctcagcctcccgagtagctgagatgacaggcgcgtgccaccacgcccggctaatttttgtacttttagtacagacgaggtttcaccatgttggtcaggctggtctctcgaactcctcacctcgtgatctgcccgccttggcctcccaaagtgctgggattacaggcgtgagccaccacgccgggccactatcatctttttaatttaggcacatagtgctcaggaaaagacaaggatgatggatggtaattaagtaaatgaagacagcattggtcaggagggcagtataaacaaagtaaaatagaaagtctcttgttctattttttttaaataatgataattatatatttcttacagtcatatccagagcttacttgaatctaaagcagtatttatctttgcagcaagcctatgaattagctttacagactgtaggatgcagagacccttggattagaaaagttcagtaacccatgagcagaggcatgagaatgttaaaacaagtcactaaaggtcacatagcattccactagctgggctgtggttagcactcatgacctcctggggtctcatcttttctgaatcttattgaatcatgccagctttctgatatggtccataaaatgctgatagaaatcacatgtgaagttcccaactgtgaggacagcagacttcctttagaagataaatactagacctaatctaatacactttatttgacgtagcagaatttctcctgcatccttatttcaaaagcatacctgcctgtggtcttcccgggtcttaggagagtccatatgtctgatggaagcagacaatctagtgctactcagagaaaccaccacttgatcctcagtttttttgaggaatttcatgtgtttttatgtgaagaatcactctcaggaaagttctgtattttggtagcagagatcctgtcaagaaggcagtgagatagatacacataataagctgttcatcattactgctgatggaactcttcccaggcctgcagctgacagcattgcatgggacctgcagcccctttcaccgtgactgcagattctttggttaagagactgtcagtggtcaaggctctgccccggcttctcgggatcttcacactcccctgtgcatagtaggctttgggttattggccatcatgaaaaccaagattgtcgtttaatgatcacatctatggacttggggtcggaggaacctggattcacatcttggctcctccactgactggtaagttgcttagattagttgcttttttcctctctggctgaatttatgcaattgggagttttaaaaagtatccactaaattcattgttgttgttgttaagatttagttgtgtattgtacactacctggcatgtagtggatgtttggtcaatggtaactattaaaattattgcagatatcctcaggtattatatttttgacaggagatatctgatagcctgattcgatattttatgtggaaggaagaattaaatacagaagaaccctaagacaatgctatctgttctagagagtgtttcgttaaagttgcagtgtttcataacgaagcaggcaggacggccctctgctatgcagagctctcccgctcatgacaacacaacaagcactcccggttcatccctacctactcatcccaacaatgtttccaagttgttttaaggattcagaatggccccactccttttcagatgtccctgggagggtaacccctgccttgtttgagaatcacgagcaagcatagtctgagtttgacttctgtacccaagtagcagggcaccacctccctctcagtggctgatggagaggtcttccacagtgaactttcagtgaagaagttcatgtctctctacattatctgttttactcagcattcagagatatgtggtgcctccacaggggccatatccaggctttctgatgaccctatagggagcaatggcaatttaatgaggaggggaaaagatcagcttaacctagcttctacttcatccgggttctcatggttagttgagagtgctgatccgtgaccaccattgagtcattgatctcccgctcttcctagtcaatctgtcattcagagatttgcttgatcccttgtgccagatgcatgtatttaacaagctaacatgcactaagcatctgctatgtgtcaggtactattagacgcatcatactacaatgactaagacacagtccttgtcctcaaagaaatagtagccctgggagtaaaaatgatataggggaggctgggcacggtagttcacgcctgtaatcctagcactttgggaggctgaggcaggcagattgcttgagcccaggagtttgagaccagcctgggcaacatagtgaaaccccgtctcctttaaaaataatcaaaatatttttaaaaagtgatttgaaggagtaacatcctgttcatgttcagaggcattcagcctatgagcccaaggagttacgctcatttctctctatgtacatcttttagtcctaatatgcgtttcttcatttcttttatttttgttaccattatactctttacacaaggtccttcaccagagacctgttatcagtgtcagagacccagccctggtggccttgtgcagcagatcagaataactcaaggagctcccacatttgctctcctgactttctagaggcacacgatatccacatatgttaatgtattggttttatcataggtttctccttgcatttctttcatgtaaaagtgttaagagttcagtctgatctgaaagcaaaagtttaagttctcagcataactattcttacaatcttgtgcctttgcaaatatgttaaaatgttctcagccccctccagtcctgaactccccatttttttatggttaacgcgctgtcaccactacccagcagactacaaagcagcagcaagtgcaatgcagagaacgcgatgtagatcttgttcaaagcagctgacatgttgtcatctcaggaagggcagaatggcaaggaggagtgattgatggaaacttgatggagcaaccttcacttaattatttttgcatagattcctgaattgtggcttctttgctggaaaaaataataatgatcctgtaatgcagactgctttagaggctggaatgtgtcatcgtatgtgaggattaccacttgctcttttagaaccccaagcatctatctctacctagaaattttttatcgtgaagactaatagccttaagggtgaaggagaggacagagaccctaacccagagtaagataggaatgattaggaatgattgttggtgataatcagatgaacacactgtagccctgtatcaggagagaaaatgtgtttgagattagcacgttatcagaaaaatgtttgcacttatcttattctttgaataagttgcaagctatttctcttctttcacaaaggcaaagtagtaagccaaacctgtaatcagaaaaatattgatatgttagatagagaaagttatttttgtgtgtttgtttcagttgttgaatcaactggtatgtatcgagtacctactgcatgtagggggattgtagagaactttcagcgtcaagttagagattttaaactttatcctagaagtaaaacgagaaattaaggcactgagttagaaaggagctagaccatgatttctcccatatctcttgtgcaaatggcactagccaagccagaagcccctatgctgttcctccatgtgcccctgcccagccattcagcagccttggtgctgagtctgcctgggacatctcccctgtccgcctcctcttctccatgcttactgcccctgcagcaggccaaacctgatgacagctcagtggcattgcagcaagttcctcccgactgtttgccttgcctgtagaacctggtcccttctcatccatcttctactctatgaccagagtgacatttttaatcaaaaaatgttcctgcctaacccttctgagattctccataccttcaagagatatcttggggagagaagggcactcgttacctccttcctcccctcctggcatgccatacttgtgcttccctgaatgtggcatgtccccttatgtgactctgcatgagctccctcctctgtctagacaatgttccctctcacatcacatgcagtcacacattcctgtgtactcttcaaaactcaaccctgccatcagctccaaggagcccaccctaacttttccctcctggtctcactgagccactctgtgcttcccacccatgaaactcatatgtaagatttttagtgtctgttctcttgaccatctctgcacactggatacagatgtattagtctcttctcacattgctatgagaactacctgagactggataatgtgtaaagaaaagaggtttaattggctcatgtttccacaggctgtacaggaaacatggctggggaggcctcaggaaacttacaatcatggcagaaggagaaggggaagccagcacgtcctacgtggctggagcaggaggaagggaaaggggaggtgctacacacttttaaacaaccagatctcatgagaactcactatcatgagaacagagagggagaaatctaagcccgtgatccagtcatctcccaccaggcccttcctccaaacactggggattacaatttgacatgagatttgggtggggacacaaatgccaaccatatcaatggagctccttgagaacaggaactgtgtcttttagatcttctgttttatatgtctgatgcatagtaggcagttggtgatcactcatttggtgaatgaagtgttaggctgaactgaagtgggaatgaatatgaagagataccacacacctgcattccttgctatctgtgccatttgttccatctcatatctcatggtcacaccagtctgagcaaggtcagatactctttttagagaaccttctgtggccttattccatgttcagttgtttaatcacgattacctttatttttgtattggtccatgtcctgagtattttttaaagcattgactgttgtggatccatggagaagtcagagaaaacagatgaagctctctgataggaaaaaggattgaataatcttgccatccaaactgtggtatcaaaatatgactatatatgttgcaatcaggtgcatgcgtttcttggctttcctggatgtgcaaaatagaattcaagacagggtacagagagaacacattctacataccccacataaccttggcatgactgtttggaccttgctggtaagaagtggcattggctagtcttttgttcacaggctggcaaggttgctcctgattttctctttacacggataattcctttactgaccaaatctcatgagagcaaagtgaagtatcctgtagctggcactacattcatgaccttttctatgacaggttaatcatttctttgtgtgttcactcactgacctttacttcattggccaaaggagtgccccatgtcaaagtaatgtcctcgttcctccattccatcatccctttggggcagaaaagatgctgtcttacccgtttttgtccccagactagctgggtgcctggtgtgtagatgttaaatgaataaattgtttaggcaaagccgttagtagcatgatctaatgaccacaaacagaaaagtgtgtgtggtggggaagggcaacttatattttaagaattgtgttttaataagtggtgaattatttcagtataaatccagtattatcattaataatagataaatatattgagcatttaccataagcaccatattctatcgcctctcccattacgtgaaagactaagttttatagtttgaaaagaaggaaaataggaaatatataactacatttaatattatagcataaagggctcaagtggaatgatgctggtatgacagagtattcccaacagtcctcccagttctttttacattaatataaaatgttccatgaattaaagaaaaatatagcaagtcataaacatttacaattctctttcctcaccatctaaggaggacaagttctgtgcttatttagcttgctattccttgtgaggtcagaaaggtcaatgattaaacttagattaggccaaattcctccttaagagaagatatggtgcggggtagggagtggggaacataagaacagccattatagggacctgtaagagaggagggcgagatgggaggaagagcaatcgtcctgggaaaagggaacttgggacagagaggagtaacaaggctttcagggagtctttctgagcatggtgccatgctccctactccccacttccaccctccccactccccccctcccattcacctctgccatccaggccttcccaggaacacttggccaagacttgcaagtttatttattttttttttagctcatcagctgtcattagtgatagtgtcttttatgtgcagcccaagacaatttttctccttccagtgtggcccagggaagccaaaagattggacacccctgctctagatgtgagtcttggatgaccacccttcactctacctaggctacagtaacagacgttgaaagtcagcatcttcattgttatggaggaatggaaatgggataaactattttaaaacaattttggatttaaaaaaatagtttaaatattcctgttctctcaccccacccacccctaacttctttgcattattaattttcttagctaatcttatttctaaaaaagcaaaaccttccaagggaattctttttcttttctttagggagagagtctcactcttgtcacccaggctggagagcactggcacgatcatagctcactgcatcctcaaacttctgggcccaagtgatgcttccacctcagcctcccaagttgctgggactataagtgcacaccaccgtacctgggtatttttttttttttttgagatggaatctcgctctgttgcccaggctggagtgcagtagtgtgatcccagctcactgcaagctccgcctcccaggttcacaccattctcctgcctggctatttttttaagcttcttgtatagatggggtcttgctatgttgcccaggctggtcttaaactcctggcctcaagggatcctcctgccttggcctcccaaagtgctgagattagagccataagccaccaggcctggcccaaatgaattattaatttgttttgggtagaattactaatagccaattactagttagtggaacttcaatttgggatgtttttatctatttgaataaactttcattctgtataactccatgtctaaatctataaatgtagacatacatcagtatagaaacgtcagtggctcttagattgggtactttaataataactctccatgactgaccactggggacttctcaaggagcaggagaagtatctaccaaacgtagatacctgagaaatagtggagtctgctgtaatgttcactgtggataacctgactggcagagttgtcccttctggaagagaggcagctcaggtcactgtgtaaggcacctgtcttaacttgcaatgggaattttgcagtcaggtgaggggcacaatatatgtgaagaggaagtgaatgttgttgatagcatcacatcataattaaattccagccactggatgatgaagtcattccttcacacacaaacggcattatatgcctgtaatatttttccagggctgccattacaaagtgccagaaactgggtgacttaacagacattgagtgtctcacagctggggggcctggaagtcagagatcaaggtgtgggcagggccatgctccctgtgaagatgctcgggaaggatctgttccaggtcactccctagcttctggtggctccttagcatgtggctctgtcactccagtcctcacagagcactctgcctgtgtgcctgagtccacatttccccctttttttttcatgatggagtcttgctctgtcacccaggctggggtgcagtggtgcgatctcacttactgcaacctctgcctcccaggttcaagagattctcctccctcattctcccgagtagctggaattataggcgcccgccaccacgccaggctaatttttgtaatagtagagacagggtttcaccatgttggctagactggtctcgaactcctgacctcatgatccgcctgcctcgacctcccaaagtgctgggattacaggcgtgagccaccgcgcccagcccacatttccccttttcacaaggacaccagttctgtcagattaggaacccctctcctccaggatgacctcatcttaactaattatatctgcaacaaccctatttccaagtaagttcacattcagaggtattaggggtcaggatgtcaatatataaatttggagggacagaattcagcccataacaatgcctgccagtggtagttttttgggggtcagggtgagtctagtatctgcattttcaacagcatgcctttttggggagatgagtgtcaagcattcactgatttgaggtaacggggccctcttgagtctgtgatgtaatctcacactcccctaagagctatttatggcctacaagcctgtgcacatttgaatgcgcgtgtgcagaaaagacaatgagccagacaggcttctacacccacttaagagcactcacatggatcagtcacccaccctgaatgccacgttagttttgacatctgaaatgtgtctggcattttcaggcagagaaggcttttaaaaaaaaaaaaaagtcacatggatgccagttccttactatctccctaaaagagcctaaacacagaaatccagacacaggaactcacaagaatattagataataaatagccaagcttctgaagaggcctggaaccagagaatgatatttaagggttattaagcttaattttttgcactgtggtctgcctggcatatagtagacactcactgaaagtttgtgaacagatgactaggagagtctctgttccgtgggtatgaatcttaaagatgcatgtattcagccccttctcctggcttctgttctaagcagagggaatctgatgccttgtttctgcgcatctgtgatctgggcagattacagatgtcacaagccagtgatgtacacctggattgcatcctgaccaaaatcagggaagtacccgctggcatgttgaggacctcctttgaagaaaatcctgtggctaaaccaattcattgcccttgggagagaaacattctatagcctgctgggtggatgtgtacagtccatgtggacccacctaagtttcctattttgttccttctttcttgttttcctttccttcctcttttcttactttttaagccacttattgagtttatcctttcaaaactcatcttgaggatatgttcaaaaatgacccatctagagcttcctgtacacttctttgcagagtgagttgctgctgacttatttctccttccagcgtcttgctgatgcctctgtagagtcatttattacctgcgtaagagtgacctctacacgtgcctggttcccaacaagacatggagtctcaactgaattttactcatctctgtttccctaatacctagtgcagtacctggttagcacttcctggatgttcagtgtatggttattgaatgaatgaatgaataagctgttactttctgcttgcatagcactgttctagagtgtcatggaggacacaaaggaatagaattgatagtaggtcattcttcagttgcgttgcatcacaagggtaaaacgtgtacttattcaaaataagtggcataataataacttcttaaaatttttattttatttttccgtaagttattgggatacaggtggtatttggttacataagttctttagtggcgatttgtgagattttggtgcacccatcacctgagcagtatacactgcaccatatttgcagtcttttatccctctccccactcccactcttccccctaagtgcccaaagtccgctgtatcattcttatgcctttgcatcctcatagcttagctctcacatatcagtgagaacatatgatgtttggttttccattcttgagttacttcacttagaataatagtctccaatctcatccaggtcactgcaaatgctgttaattcattcctttttatggctgagtagtattccatcatatatatgtaccacagttcctttatccactcaattgatgggcatttgggttggttccatgattttgcaattgtgaattgtgctgctataaacatgcgtgtgcaagtatctttttcgaataatgacttattttcctctgggtagatacccagtagtgggcttgctgaatcggcatcataataacttaataagtcaagaggaggtctgggcactgtgctcatgcctatactcccagcattttgggaagctgaggtgggaggactgcttgaacccaggagtttgagaccagcctgggaaatatagtgagactttgtctttacaaaaaagttaaaaaattagccaggggtggtggtgtgcacctgtagtcccagctactcaggaggctgaggtgggaggatatttcagccagggcagtcaaggctgcggtgagccgtgattgcaccactgcactccagcctcggtgacagagtgagaccctgtctctaaataaataaataaataaataaataaataaataaataaagtcaagagaggggcccagtggtgtaatggaagagcactgttcatagaatctgtagatttgttttctagtcctggctccacaagttacatattctgtgctcctgggaacttcccttaacctacatgagcctgagtttactgatctaaaaagtgggcctaacgcctatctgaaagaattactggggatattaagggtataatgtatattataaagtgcttggtaagtcatagcatggtatctaaatctaaggtatgttgcttttatgacacaaggcagtatctgagttaggacagaccaggggagtggtacaatcagttaatgttctgagttgctgggtaggagttagcaagtaaggcacgtgcaagaattagaacttggccagagctttgaagaataaggccacctggcatagacaaagggaagcagtgtggcctgagtacctgcacacaggttgtggtgggccaggaggatatgaacgagccccatggctgccatagagggctggtggtgcccgagatggccctccttgccatgaagtaggcagaaggcgcttagagctctagtttcccaaatggagctcaattgcttgtcatattacatacacgtgctgttatgtgtgatgatgctctgttctaaccctgaaagacctggtggagccttagcaaatcactggccattctcccaaacactgcgtgtgcttatgctatgccgccatagttttacaagcatttttcagcgtttatgcaaatgctgcccttctgtctttggtaactgctttgctcatctttcaggattcagcttacatcttgtcttctctgtgccacattcctgtcagcagccacctcacaccacccgctcctgtgcacacaggcgtacagagatagtcttgttcctctctgctcttagagcaccattcagctacccccagtggagcactaatcccagtgagctgtgatggtttcttggtgtctgtctccccgcgagaccatgggctcttggtgaacagcggctgtagcctgttcagctctgaccctccggaccctcatataacctgtatgacccatgaaggtgcacagcaatgggaaggatgagggaagaagaaggatcttttcaaactctgtacattcttcacacagaaaagcaggctcatatcagctgacttgttctcccaggcagagaacaagagtgtgccacattcactccagttgaatggtttcaaacttttcttcctttgaggtggatgtatttttggcttttggcagtgtcttagtccatttggactgctaagcaaaataccgtaaacttataaacaacagaaatacatttctcacagtgctggtggctgggaagtccaagatcaaggtgccagcagcttcaggatttggtgaggtttgatttttttggttcatagatgacaccttcttggtgtgtcctcacatggtggaaggagcaaggtcgctctctggggtcccttatagatgggcactaatcccatatatgagggatactgaaagtaaattgatggaagtgctcgtgtgaatgaatgaatgaatgaaaccattttgaagctagattgctaggttcctgcaggttatatctttgtatactccttacctttcaagaatgtctgcagctctctgcatacaataacttccttgagtatatataactacagtatgacaaggcttttaaattgaacaattctaaagactgtttttttgagtccaaaaagtagaatttggtatcaacattaggtttaaaagaagtgatttcagagtttgtcaactattcaagtgtcagaaaaaaataatgtaaatgatgtgcttaagacatttatttttgtattctcgattctcctgaaataaagggaaattgtcttgaaaagctgtagattttaaatgaaaaggaaagcgggaaggtgacataatttgcctctgcctttgcagaaattcaagtgtatatggcctctctccaatccaccattttcccacctccacaggccccatgtcagctgtttccttcatatcattgcaatgctttgagggtgattgttggtttaagctacagtcccttcaaatttgtgaaagactaaacagattgataacaactccacctagattaaatgaaattctgtgggtagacaggctagtcaaaatacaatccccacacaccccaagtgagcattgcttctcctttcagatatgctgtgggtacaaagaaaggatttagtccaaagtgccttggggttttgttcagtccagagtgtaatttttttctctcttttgcctatagccatttctgtaacattactgaaagggcttttttcctaatgaagcatgaaaattgatcgtatcttgccaggagagttcttcctaagtcttaagatattaaagatttcatgagaaccgcatgaagaatatcttcttgaatcatttacatttttcccttttgtaggcttatgtaaccatgcagaaaatctaataataagtgtgctattagtgtaccatgtgccatcccgcaggcagctgtgccatggggcaccagtgcccagggcttgtggatagcattaacctgtacaactttctaaagtaaagcccagtgggaaatctgtaggtaattgaacagatagtccatttttatcagacttccccctgccccttccctgttctgtcttttctcttttcttgtgccagaaggaaacaccttggccataggcctttcattcacaatggagtatattttccaaagcaaatagcttggactatttcaattcccagagcaatctaggtgggcacacagagctaaatttgggtttgaaagaactcttaaattagtatcataggaaggcaatgagcaggaaaaaaaaaaataaagatacaagcattgtggtctgatggaaattatccagcactcacttacaaatgacaagtgggtaccacccagcctttctcatgttccaaaatttaataaagggttccatctaggtcccccagaaactactgtgattatcagggtgagagaagggggaatgatgaatttttgtaatgccccaatctttgtaaccaggcatagaaggacattcgctgggctcaggatgggtgttagcatgtagtggataaaggaattgcagagttgttgacagctgtttcctcagagacacttgtcctgatgatatttgctttggattctaagtaacagagctgtagttcttaaagtttaaattgaaaaaaaggagttttctgtcaagtggcttagtcatggaaatcagtgaagttaagcttgggcaataatatatccttttcaaatccaggtgccttcctgatcatgccagagcttttgtgactcctttctccttggtgttcttcttttgatgcggcgatagggtctgaacacgtccaggctgtctttgctgggagagggcagaatgcctcggctttcttcagccttgcctttcttcattgtcttcaccctgcagcacttctgcaaagctgctggggtaggtgggtgagtgggcgtcttttctttgctagcccaagctgagttctgaagggaagttagcagggctcagctgctgccgcaaagtcagtcagaccaattctcatttgcatgcctacagaattagacatattcaggggctcgggttaatgccataccctcctcttgtccttggaaaactgtaagaatgcgtgcaggtaactctgcagcaattctgtgttgctcagatgtatttctcttctttcagaattcctccttctatagcattcccctaatatttatgtgctggggctttcttctttcatcccaggccccagcttcgctctatatcagacagaggtgggagctgctgatcaagggggcacacttgccatccaaacctcacgatgctcacaggtgtcctttcaaccctgctaacccagatgatacatcaccatttatacctttggaggcattttctctttaattgatgctcacttagacctaagattgttcattaaagtccagaggtgctcattaaaatgaacattggatagtgtggtagatgcaggttatcattatgaatccaagaaagggctctgtggaacttgttatatacggcatttataggttgttaaattaaaggattagtgttgtgctaaaccattttcaggttaatcagttgtgggaaaccagatctaatgttaaagcaggcttaaactatggtttttatagtagggaagtttttaagctactgttatttctaataaaccctctagcttgctaatcgagcatacttttcaatttttgcacttaactgaatatggtcttgttccctaatttttttatgtgtgggctttatttcttcaagctggattgtaagttcctttttagcagggtctatgtcttttttttttttttttttgctcatatcctaaaagcttctggtataattcgaggtatatagcagatgctaaggattttattgagtgattactacatttttagagtgtcattacaatgtattatcacctggtttatgccgtggtgctttatgtaacatgtgcctatttacagaacattgatataacatgttggtctgcaaccaggttgttatcagcaataggaaaagcattacagagttcatatggaagtagaggagaaacaggtctaatttgggtgtgatgccctgtattagtctgttttcatgctgctaataaagacatacccaagcctaggtaatttataaagaaaaagaggtttaatggactcacagttccacgtggctggggaggcttcacaatcatggtggaaggcaaaaggcatgtcttacatggcagcaggcaagagaaaatgagaggcaatcaaaaggggaaacctcttataaaacaatcagatctcgtgagacttattcactaccacgagaacagtatgggggaaactgcccccattattcagttgtctcccagcaggtccctcctacaatatgtgggaattgtgggagctacgattcaggatgacacttgggtggggacacagccaaactatatcatgccctaacctgatcagatatggcttccagactggcccctggagtggcctgaataccttcaccaagacacgtgtgtgggacagatcaaaagtttccatctgccatttgtctttcacttggtaactgctaatgattgcttgttaaccatacacattaatatgcccgtgaagcagatagaaaataaaataagtaaaaaattgtataagtggaaaaactaagacccaaacaagaaattatggatcatttctaaatggtggccaggacgtttatacggagaaaccataccattgaaccataatcaatgtaagaatacaactgatggtttcagactttcaggaatagaatgagtctcaggcagacatgttctcaggcaacatggcctgggacatccccagaaacctcctccatggagttaacaggacacctacatggccctatgtgtccctccacttgggcctcttgttcaacctcgtatcacatgtccccttcctaccacataaacttctgtctctacattctctactctaccacaggttcatttatttgtttgtttgtttgtttgtttgtttgtttgtttatttatttatttatttattttgatacagtgtctcactttgctgtccagctggagtgcagtgtgcaatcacagctccctatagcctctgtctcccaggctcaagtgatcctcctgcctcagcctccctagtagcaaggactatagacatgtgccaccacgcccagctaatttttaccttttttttgtagagatgagttctcactgggttgcccaggctggtctcaaactcctgggctcaagtgatccttctgcctcagactcccaaagagcttggattacagacatgagccactgtgcccagcccacagtcatgttttaaagtgtctgagctataaatactactataaaggtgtcaactggttgtatatgtgggcccttggcatttcagaaatgacagttattgccaaccattaccaaatggaatccattttatccaaatgggcatggttggggctgagcatgggatggagtaatgcagtcttattgcatttcagtgttagagggctttcactcggtttgcagtttctccacagctcacccaccaattctacctgtgtacttcttttctgttccctctcaacttcttttccattctctccttcctcttgtttctgtccatatctctggcttcttttaatttcccttttcccttctttcttattggtctggccctgggtctggtgagaccaagggcacagaaggatactggctccatgccaacctttcctccaaggcacaatctccttcttggcatttactgagatgttcaacttcctgtgtttctaatattccttcctgttttataaaagaaaaatagattggatttgcaaagtgccttaatttgttgattttctaaaaagcaattttaaaaatgtgtatcaacaatatcacatacatgtaactgatttattgactctggcttgccctgggtttaatcacacataaagaaattttacaataacacatgatccagtagagaaagaagtcaaagaaatatgtaaagtcctgtgacctctgtagacatttgggattaaaccaaattaaaacacctgtatgggctgggcatggtggctcatgcctgtaattccagcactttgggaggctaaggcaggaggatcacttgagcccaggattttgagaccagcctaggtaccatagcaagacccaatctctactgaaaaaaataaaaataaaaataaaaataaaaataaaaataaataaccaggcatagtggcatgcctgtagtcccagctactcaggaagctgagatgggaggatcacttgagccagcagtttgagactgcagtgagctatgattgcaccactgcactctagatgcaacagagcaagaccctgtctcggctcaaaaaaaagaaaacacttgtatcaattcaggtcaaatattggtttcttttttttaagagcagattaacatcttgcatatcttttgctatcacatttcttcttatctgaccagctgaaatggaactagtgttaaatacaaataataaaacctgtaaagatcctaagtttttgcatggtacaataaatcctcactcattcacatgcttggagaaagtccagtctgattcaattaatgaaaagcaaaaaaaaaaaaaaattgtaactacataatttttatctcatgtattagctcctatttagttcacataagtgttcaaataggtactcatttttaattaacaaaatatttgtgtgtagtgagtatttttaaaccaattaaaacagttccttcttgtaagtaaattaagtgctattcttagacgatggtatgcatcattcatttgctttgcaaaccattctttcacaccattctagttggtgtgaaagcaaattgagcccatctctactggaatttattgcattctcttaatttctgacactctatgctcccaatagtagggactccatcttagccaccacgacatcccaggcatggctcctagaataatttcagctctttaagactcaattaatatttgctcactgattaatatttagctccattaatttatgtgtccaaattccttaccatttgccaagtgcttttggattttacagttagttacaaactgtagtttaaggtttttctggctttacttcattcttcctttaactagctttaaaaaactagtttataattctagttacaatacaatgttaagtgaaagaactgattcaaaattatatattcagaattattctaactttgtaaacatgcatagatatatgtgagctttaaaaaagaaaattatatatatatgccaaaatacaatcaaaatgtaaatagtggatatatcatgttggagatattaggagcagttttatattttttaagttttctgtgtttccacatatgatcacactttatttttatatcagaaaaaagctatcttagttgtgcattgtacattagaaatattagttttgaagataacctaaacacaagtttttatttcttctgtcacagttgcctcttttcttaaaatcgtgtttgccagtttctttcacgacactgcaaacaattttagtagcttcagttctttgataaatctgtagcttttagatctttgattactattagcaaagaaaagatagacccaaatgaaaaacagttgcatttttgaaatatgtccggcgggggttgatgtggaaagaacaattcctctcaactccagggtcaaagcagcagccctgccaggctctgtcggggtcgcctggagaacatcacttaactttctacatcagttcctgcttctggacattataacattcatgatatccacctcatgcaggattcctgggaggagcagatcagatcataatgtgtgtgaaggggctttgaacgacagtcaccacattattaccaccataagcattatttccatttcaaaaatggtagaggagggaagatgcagatgttctctttatgttggctcggcaccaggcacgtccaggttgtgctgctttaccctccagcatgaagagttagaaggtaaatatcgatattgcttttcataactaatagcttcatagttcatgtcaggtgatttcttggcttccgttagcatttcagagaccattatacacagcagccatcctctgcagagctggagaaaactcatttttcaaggcaaatagtcccaagtcagggttcagtcctggtggaatgaaataaagaaggagagtttatctttaaggtaagctagcatttaagtagatgttggatattatcagagatgcttatgaggggcagagagcattgaagacttataccctttgcacatctttaaatgcctgtaagtgcttaccaggagccaagagcgaacgggtggctgcgtgcaaatgctagaggttaacccctgtccatgggcatttaccgcatgagtaaaaatttattgcagagttcaggactgtgattctgctgctcatttctgtagcgtatttctttatctgaaaggatgcccattgtcctttctagctttttgggccataaccgtgagggaaggcccaaaggaagaacctctgttggagatcaggtttattcatccatgtgggtggaggtacgaaggagggaagaacctctgttggatatcgggtttctttgtctgtgtgggttggagactagtagaataggggaaaccacatactgcccattcctccaggatcattttccatttggatatttagaaagcaacaagagaggagttttagaagacaaggtagatgatttcaagttactttaacatagaggaagaaagtttccttctatttttaatggctagtgcatgatttgtgggagtgaagattgggagggggcacggacgaacaccaggaagaggcggttaatttattggtccccattaattgaatttaataagtgagttttgtcagtttagcaatatccattagtttcagagagtgtttcagtattattctgtaaaagcatccagggatatattttacagctacagcatagattatcttgcacacatattgaagtaaagatacctttcaacattccagatactgacttttcacccaaatttgaaaatctccatttagcactttctaaaataccagtgaaaattaatatagttttgtagatttatgtactaagatgcagattaagacatgtggaatctaatgaacatagcaggaaaagaaaattttctcaagtctgttcattactattcctcatcacattttttattatttaatagcttattccttgaatatgtgtgacttgggattagatgtgccagttggaagacctcagaggttcagaaattcacagacatgtgaaatataaaaccgtattcatttagcagatactgataggcatataaaatagaaccttcatcatctatctttagaaaaagaagattaaacagaagtgtaattaatttgccaactctgcttcccgattgagacatttatcaaagttgatctttaatcattagtttcctaatctgtaaaatgaagtctattatgacctctaaggtctatttgtaacagttaggattaggttcagttccatatcaccaaaaaaaaaaaaaaaaaaaaaaaagaagaagaagtcaagccaaagaaatagacatttatttttctctcacataaaagtggttttgagaggtaagcagtccagggtgattatggtcactgcacaggctcagaaacattgtcacctttctattctgccatgctgtagtatatttcttttcttttctttctttttttttttgagacagattcttgctctgtctcccaggctggagtgcagtggcatgatttcagctcactgcaacctcttcctcttgggttcgagcaattgtcctgcctcaggctcccgagtaactgggactacaggtgcgcaccaacatgtctggctaatttttatgtattttttagtagagacagggtttcacatgttggccaagctggtctcgaactcctgacctcaagtgatgcacccgcctcagcctatgtctcacatacaagatggctgcatagctctagcctttaacattaccattccagaaagcagaaaggaggaagagacgaaggacctaccccctttccaaagacacttgccagaggaaccataccacatttttgtttacttcatgtcaacaagaatttagtctaggcatacctagctgcaaggctaggcataccttcttgcaagtctaggcataccttcttgcaaggcaagaagaagatcaggtcattcagttgggcagcaatgtgtctacctcaaaaccaaggtttctacttctaaggaaaagaaggaaagtgggatattggggtaagcaacaattatccacaggttttgagctcaaaaagccgtgatcgcatgtttctgggaaaatttgacctatacaatcgagtctgaatgtgtgctgggtgtgtacaaatcagacaacttcaactgtgagccttcattagctctcccctttatctagacttaggattgtatttccaggcataggtcagaatctttacactgattgtgtgtgtgtctgtatgtgtgtgtgtgtgtgtgtgtgtgagagagagagagagagagagagagagagaaacagaatcttggctgcaagatgtgctgaatataaacacaataacttagcaatttataactgcccctttcccatctctgccccctccccagtatcagcatacgcagtgttacccccacactatcaatatgtcaatgattaatagcaactggcaaatgtgtgctttccatgagacttgtatgcaaggttactcgggttcacagaggctgctaataacagcagcactattgaattatgctatgtgtctgtgtctgttaagacaggtcggaggacaggggaggaaacttcccccagggtaattgagagacaaagtcactaaaagctacagatctccagtttgggctctatgcatgagattgttcttaaaagtcaaagaaatataaaaggaaattgcacatttgtaatttttttaagttccccatttcatagctcattaaaaccaggactttaatattctgggtcagaacccccattggatatttttgtgaacatgtaacatgtgggttgattagaggtttgggcctgtttttttctttttctttttttttttttttcagacagagtctcactctgtcacccaggctggagtgtagtggtgtagtctcggctcactgcaacctccacctcccgggttcaagtgattctcctgtctcagcctcccgagtagctgggattacaggtgcccgccatcatgcccggctaatttttgtatttttaatagagaaggggtttcaatatgttggctagtctggtctccaacacctgacctcaagtgatccacctgcctcggcctcccaaagtgctgggattacaggcatgagccaccgtgcccagcctggcctattttatttcatgcatatatagtttaagtgtctctgagattcttgatcaactaacaaaatccaagaggcccttttgttatattctaaattcattcctgcttctgattgttgcaaaggggtcagcggatagggtgccagagccagaagttagctaggtggcaggttctgaattaatgtggtattctgggtaatataatgtcatttcctagggaactgccagcatctagctgacctccaagaggacaagtggtcaggaaggtggagatagtattagaactgttattattgttgttgtttttaacaagcagacctgtcatgaaacttgccatagaggtccccttttccatatatcaccaaagcctcataggtaagaaaaggtaaacatccaagattgtttctttaaagattgctgttgggcagaccaagatttagccacaaaaataaacataatctctgatgctgagaagagatcagaatgagttgaaacacaggggaaaaaagaagtaagcagaaaaaaattttacaatagtagatatggggattagatagatagacggctatatagatatataggactctgaatagacccattacaggcaggcatgtaagtggaaatgattaatatatagatgtagacacaggtaattctatataaatgtggaagagcagcaggaagtttctacagctgggaaggaaaaggtaattttttaaaaatgaggtcattacaggttgtttgggtccaggcagattcccattgtcctccctaaacactgcttgtaaacagttttgggactgaatgcaccctttgactgtagtctatgctttacattgactagaactgacaaacagatgaaaagtaaaataatgtttctagagattttctatttggttatgtcatttttttccatggacacatctggctaaagccaaggggtgttaagcccccaaatgtcatttgaatgttcttacagtatgaagaagaggaagaagaaacactttgaaaaccaataattcggccaggcgcagtggctcaatgcctgtaatcccagcactttgggaggccaatgtgggtggatcacctgaggtcaggagttcgagaccagcctggccaacatggtgaaaccccatctctactaaaaatacaaaaagttaggcaggcgtggtgatgcgtgcctgcagtcccagctactcaggaggctgaggcagaagaatcacttgaacttgggaggcagaggttgcagtaagccaaggttgcaccactgcactccagcctgggcaacagagtgagactttgtctcaataagaaaaaaaagaaaaccggtaattctgttttggaactccttgctctgctatggcacatgtatacatatgtaacaaacgtgcacattgtgcatatgtaccctagaacttaaagtgtaataaaatatatatatatatgaaaaaagaaaaagaaaacaacagtgctgattgaggtgtcacacttttgctggttgtctctcctgggtatacctctagcttatcaccgccattctgggaagacaggagcaactgccttttagctgtagtcaccactcatttccctgttagccccttgtggactggaagctccttgaaggagacaaggcaccaagtcacattttacttcatatcccaccaccatgatgtgcctggcacgtaaatgttgaataatctgaacgagtggatccctgaacagtttaataaaatggggtttaaggagactgtgacattcatgaatagcatcacatccaggcttatttctatggctttctattgggctcaatgcctgggtccctggcacatgagaaacaagtatccttgagcagtaggggaaccataccttattcttaccacctcaaaatatctagaactggctgggtgcggtggctcatgcctgtaatcccagcacattgggaggctgaggcgggcagatcacgaggtcaggagatcgagaccatcctggctaacacagtgaaaccctatctctactaaaaatacaaaaaattagccaggcgtggtggcgggtgcctgtagtcccagatactcgggaggctgaggcaggagaatggtgtgaacgtggaggcggagcttgcagtgagctgagatcgcgccactgcactccagcctggcgacagaacgagcctccatctccaaaaaaaaaaaatctagaacctcagcatgaagccatttttaaaatggtgccctatacttagtcaaattcaggcaattcagtttggggaattattttctgtaaatgaggtgctctgaatcagagttctgactccagctttactggctgcctaagtgccatggtttagtgtaatgaaaatacagtggggggtccttaaggcatcattcagggtctacctttaagcgactccagctcttgaacttaatgaactggacactttcaagttctgaacatggtaaataaaagccagcacctgctgccaaaataccttgtctcataatcaaaatcatttctagagccagcggaacatggattccctgagaaattcccactgactcagcaattttaggttgggattttattttagagtcacttaacgaaaagatttcacctagtggcatggccccaatatttatcaggtaactctggccccatctcagcagactgactgattcaatcatcttaccctttactggggatgaaacgaaatgcttactaactcactcctgaccccacctgccactccaagtcattccagcaaacaaatccgtaatagattgctgagagggggaagataggtgaaattggagaatacactaaaaatcaactagttttaaacggtacgggtgggagccatgccccctctgtactggtccactttataaatcccagagggaactcattctatgcttgaaggaaaactttgccttgttctttggttagattgtgctgaacagatcaattcatgtcaaagagcatcaacttttcttatttatgccatggcttccataccacatcacactttatttactcttagtggaaccttgaatcaatgatcaattttgttttgtccttcagtggagtatcagacaccaggacaacctggtcagcaaatattctgaagtcctcagcagttattactagacaggatattagcatatggcacatcatggaattaatttatgtaacacatacttagcatgcacctatcaaatatgtatcaggcacagtgccacggccttaggatggagaagaaaaaacatagttcttgctctcagagagcttagatctagaagttgatagatgctgttttccaagtttctccacttgtatttctgaaactgtgaacagccaactgacatgtagtaagcaatcatttttccagaaaaagtctgttggggtgaaataacatgataagggatctgagaaaagtaggcagggtagggatggcaatggggaagattccgttataaaggaacagcatacatatagattatatcgctgtatatttgtgtctgtgaagcacctcatttaattagatggtatcatggcaactagaagagtgcttacttaaatgagcggctccatgcaaagccctagcagactgaaagtgctttgtaggtattagctgttattattcctactgctcatcactaatatgtagtaggcactccataaaggtttgcgacatgagtgggtgggagatttagtgctgaaatgtaaacctatacataaactgaatatcacatctatatgaatagagaaccttttacagtacaagcaagagcaagatgttcacattatattctgcaaagaatgatctgaacacttaaacttacaggctccgaaagtgtctctctgcccaacatccctatccatttaaatagaaatggcagtagcagcttcctggtgctgctggtgggaagagccgtggtaaggtgtctcctttctttcactccggagcgggggtgatgacaggagagggaccgggcgggagcgaagtgatgatggtgataatgggggtaactgctgagagcgggagggtgggggccaggaacaggaggagtgtgagcgtgagaagacagtgctcagaagccgacacccaggtgacttctctggaatctccctgctctgaaatgggtaacgtggctcctttctctgaagctccaacacttaaaggagcttcttgttttaagcttcttgtgttaagctccagatttttacaagcatctcttcagagcctggtctccaaagccatccgtccagtcagatcaagagctacttgccctgtttctccatagtcacgaactggttaatgtgaggggaaggcaagaatggtctccatcgtcacgggtttctgccttggtttgaagcaagctccagcagttacatgaacaccagttacggaatgtctacagttatgacaagacacagcagggctgacccggctcacccagcaagggaacaaaggccatccacacgtcagacccagcaattcaggtgaaggaacacacagaacctcctagttcgctggatgaggagtcccccaatttcaccagataatcacacaacatgttttcatatggccacatgcccacagcctcaagaaggtgaagcattttcagagaatgattcctgacactacagaaacattgaccatttagaatcagaagaccctcagtcaaggctggcctcacaggaaaatcaaatgtaatgattcccataatgagttcaagccagacaactgaattatgcatctgacattaaaacaactgggggattgtaggaggaggagaagtttgggaagagagaggacagtgtaatcttctgggagtaaaatttattactgaacattaaaaaaagatctgcaagttaagttgagagtcattttgtttatactcgaaatgctacaatgtcctttgatttgtttatgcaagttttaggggacaagttacgtttttttagcatataatctacatttattcccaaaacactgctcctgagacaatccatcagatatttcctcaaggctgtggaaaaggggataaaaggcatatttttaaaggtgggcgtgtatgtgcaaaacatgtttgttttaaagagatctgaatgctgtagaaataattagccatgtgcgtgaacgaaaataatgaataccaaatggtacaatgtcctgcttgaatcctgtttcagaaacagaatgtgaaggaaacattacgttctctcatccctctcttttctctttcacccttgttacccctgaattttgtaataatcactattacccttttggctatgaatttaatgtctctatatatagagccacacccctaacacagattcttcttgcctctcagagacagttaaatgtctttgggtattgcactacttattctccataggggctcagacatattcactattgagcattttcattagctaaaataaattaaatgtatgtcgtaaatgtgcagcaacactgaagaagctgcgagctacatcttgtccttgggagtcatttacttagaataagtaaagactttctcacttgctagtttcaggcgtcttaccttgtgttattccttacaaatggacagggctgttctagaacccacttcctgaatacagggaaagaccccagtggtgtattgggataatggagacagacaggtctgaatgtgaggtgtggacgtgggcttgtgtgtgtgttttctccactggatttcttcaaacctaaagttgctggatcacatttctaacaacaatttgcctgaccttataggatctcctttctcactgaatatgttacgattagaggaactaagattggctaaaggacttttggaatgagccctggacttaaaaacccgttgaagagggagcaaacaagaggaacagtgttttccaagaggcttacttctcttaaattgaaatatagtcatgttccctggctctgagggcactttctcagagcccatatgtttattcaagcatttgcttcgtgatgtgggaggctcagccagtgtaatcccaggcatgagatgttcaaatgctgaatatgttattcaagcacattatttcccattgacatatgtaaatttaaaaataaaataataatgcaaatttacatattgaatcttgggaatggaaaacacatttccgatgtcactgggtatatctgttcccctactttaaaataggactatagagctgttctctttgaagtcatctctgaccatacagtttaatccagtgggcattaattcagattctgggttagtgtcttgtagaagctctccggtgcttctaatattcagcagatattgagaacccatggtctaatccaatggccattcttagtctttctgtttctctgctgcatttaatataattgatgtcttaattttcttctgtcttttttatttttattttttacgtccataggttttgggggaacaggtggtgtttggttacatgaataagttcttcggtggtgatttctgagattttcggtgcagccatcacccgagcactatacactgtacccattttgtagtcatttatccctcacccccctcccaccctttctcccaagtccccaaagtccactgtatcattgtgaggcctttgcatcctcatggcttggctcccacttatgcgtgagaacatactgttataggatctctggggtgtcaatttttctgatgggaaacttctgtggccgcaacgccttttaagcccaagtttttgtcctgcgtccagaaagaatgaggtacacagacatgtgaagggtgaaaaagaagagttttatttagtgttagaacaactcggaggagtggggagctcctctctataagcagatcgtcccattgagtgttcagctctcagcagagaggaggccctggaaagggtggctcctctctgcaggcaagtcattctgcaggtctctgaagcactcctcttagcagagagggtagctcctctctgccagcaggtcatctctgcagctggttgtcccatcgtctccagctatcagcagagagggtactcctctctgcaactggtcatccagtcccattctctctctgccccctttgtccctggccatcctcctgcctgctgtggctaagcccagggcttttatggacctcagaggggaggaagtatgtgccaattggtccatgggtggccatgggtggacggaagaggcaccacgagtccccactctggtcggcaggactggcagcccggcccccagccttcaggccctccctcgcctgaaggtggggcctaattggggactcccctcttttctgccccggaccctgtcttcctcctgctgccattcatggccccggggcttggccccaacccagctctgagatctgagtgggtgcctggaacggagagaggccaggcagtgggcgcagacacatctgagcatgcagagatggggagggtccttcctggggcgcccaagggtgcaggctgcagagacgcccaggtcctgtgcctgggagggttggccacagctgcacccgggagctcccgccctgacaactcggaaggggcagggctcccgcttgttcctggctcctgcctgcttcctggaatgggaggcccaggtctgcagccgtgggtgcggcagctgcagctgcacctgggaaggcagatcctgcctgttccaggctcccccaagagcacagggagactcggatctacagctgcagtttgggtggctgtggccccaagagggcggggctcctgcttgctctgtggagcaggaggcctgggtctgcagctgcagttcaggtggctgcagtggcacgcggagctcccatcccaactcggaatgaacagggctgccaccagctccatggagtatgcagcaccagccgcgcagccagcttgatggcagcagccactgccatcattacggtgttcagttttccattcctgagttacttcacttagaataatggtatccagttccaaacaggttgctgtgaatgctattattttgttcctttttatggctgagtagtattctgtgatatatacatacaataatttatccactcattgattgatgggcatttgggctggttccatatttctgcaattgcgaattgtgctgctgtaaacatgcatgtgcaagtatctttttcataagacgtctcctctgggtagatacccagtagtgggattgttggatcaaatggtagttctactttaagttctttaaggaatctccacactgttttccatagtggttgtattagtctacattcccaccagcaatgtaaaagtgttcccgtttcaccacatccccatcaatatctatcattttttttattatggccatttttgcatcttcgcccttcttgactacttttcctctctctaaccaaaattatggtaggtgtttgctcttcttgccttttgattgcctttcttggatatttctcccagtgtcagcttccctcccgggtactggtgctgcttctgtcaccccgttcccttacctactcttggtcctttcaggagagttcctgtatgtttatcttagagccacgtaaagctaaatgggtcttactatctttattaacgagctttattatctgcccctcctctagcttagcactctgtccattctgtgtatcttattgcagttgtacctttcctattcccacctgagagctcccactcctttggttcaacccagcttccatcaatcattcctcgagccttgccaattttttgtctctcttccatgtttattgtcgctacctgagtctagaccctctgggaactgagctgattggattgcagtcttctgcacggggagccatggtgtagagtggaaagtgtaatggatgtggagttagaaagatcaaattctggactcggttaagcatttaattaaaatgtcttggccaggcatggtggctcacacctgtaatcccagcactttgggaggccgatgtgggtggatcatttgaggtcaggagtttgagaccagcctgaccaacatggtgaaatctcgcctctaccaaaaatacaaaaattagccgggcatggtggcgggcacctgtagtcccagctactcaggaggctgaggcagaagaaccgcttgaacccgggaggcagaggttgcagtgagccggggtcacgccactgcactccagcctgggtgacagagtgagactgcgtctcaaaaagcaaaaaaaaataaaataaaataaataaaataaaataaaataaaataaaaaataataaaataaaaataaaaatgtctcaaacccataggaccttagtagtgcatatttgtctctaggcctgtttcgccacctataaaataagctgcattttataaatggaataactataaatgaatataaatcgatgtggaatttgcataaattccatatagatttgggtttcttggccttatgctgaaaccagcatttgagactgttggtgaaaagaatataaagaggtggtgtggtgtacatattactgtccgtattatggtctgattgtcaccacagtcctccatattagctttttatatgacccctgctttcccaatctagatctccagaatttttttggtgttttttgaatataatcaaaagtttgttttgctcaagattcatcttcctaaaaatgtttgacaaatgcctaatttgaaaattagtttgctgtcttcaagcttctcttaggaaagaaacgtggtccaaaagaagtttgtctagtatgcagggatttttaaaaactggataacccagggtggtctgcataagttatatgcttttcccccaaagaatttcaaacggctttcctggtatcatttgtccttatgtttctttagttccaggacagttcatactgttcttggcagcttacaaaatgagaaactgaggtattgtaattcagtctacttcccttccaaggaaaattgaaaaacactgtggggaaaatactaacaattatgtgagcctcaactttagattctgaaaaatttattcatggaaagcaaaaattcattactattcccataacattgccaacagcaaagagattatattcagaattaaatacagccctgttccatttcttctttgctttgaaactcagtgtgagacagcagtggaaccttttctgacttaaggccaaattaggtcaaaaacctttgctttgaaccttctgagtcatagaataagcagggaggaggaagaaaatccgtgacctgtgccacgattttttactgaggttttgtgcaaagagtgccgtgggcaggaaatgtaggaagaagagaggacatcacttcttcagtgtttccctgtatgtccagagataggaaattcagacatttgctttatttgctaaacttcacagatgtgagcaagaggaatattagaggcaatgtgtctaaattacttacttcgatgtaatgacttcagagctctcaggaggagaatggtcgcggggaaggaacgagcccaaccaatggcatgcccagagtcagcccttcatctgcagttttaagaagtggtggttggagcaagacgtgtttgcagttacaggaataagcaggagagggcagctcaagttgcccatcaaaagggtgggtgaggggctgggcgtggtgcctcacgcctgtaatcccagcactttgggaggccaaggcgggtggatcacctgaggtcaggaattcaagaccagccttgccaatacggtgaaaccccgtctctactaaaaatagaaaaaaattagccgggcgtggtggcgcatgcctataatcccagctactcaggaggctgaggcaggagaattgtttgaacctgggaggcagaggttgcagtgagccgagatcgtgccacttcacaccggcctgggcgacagagcgagactccgtctcaaaaaagaaaaaaaaaaaagggtgggtgagtattcctgcaggaaggggaagattgagcagagaaaaatgtcatccctttcttatccatggggcttctcctcccccaccaagctcatccatcagggtcgacactgctcttgtttgtgtcttcgcttagaagagcctgctagaagagtggcagatgagtcacctgtcactaaaagtaggtgttcttagtgctggggaaaatggaaggtggcagcaaattcctgctgcagttttccgtaaaattggattaccactactggttttaggtgcccctggttttaggtgctctgtatgtaagtttgtgcaaaagtacagcggcatctgtgggcatccaagctgggttctgctctcagcaaactgaagcaagcccaggccagtccaagggaagatggctgtggaccttccttctgttttatgcagcctagtttgaggcagttcaactgccccagagttaaacagttcaccatacataatagaggacttcgtaattaaaataaatacctctccaccaagagaggagaaaaagaaagatgtgcacagtgtgatgcagaaatgcaaggtgccctaaagtcaaatatgttacaggacacagtgtgcagctgtcagggcctctggccagtctccagctatgctggaggtattttctgtgctctgaccataggctacaagaccacatggctgctgctccactctgtagagtttcttgcatatcagaaaatctgagacctgacatttgtgatgaatatttcttgtacccatcacaaatcagaagaacaacccagagaggatgtcaggcacctgttggtctttcctcttgatctacttgttgcctccaagcaactaaggttctttttagagctctcacccctcaaagtgtagataattatattatcctctaaatatctaaaaactttgtttaaaaggactcgattttgttttctgggaaaagcttggtttaatacaaacaaattccatgtgtaacccagctttataaaatagaagggtccgagtgcggtggctgtaatccccacactttgggaggctgaggcaggtagatcaggaggtcaggagattgagaccatcctggctaacacagtgaaatcccgtctctactaaaaatacaaaaaattagccaggcatggtggcgcacacctgtagtcccagctactagagaggctgaggcaggagaatcgcttgaacccaggaggcagaggttgcagtgagccgagattgcaccactgcactccagcctgggcgacagagcgagactccatctcaaaaaaaaaaataagtgaaataagatagaaggaagggggtctggctttattgtggagggcactgttttagggaggtacatacatgaatatgttcctccgtcagggaactgagggtccactgcactgattctcaaccatggctgcacattgaaatcactgatacccactccgaccctataggttctgagttcagtggcctggagtgtggtgtgaccggcaagacttttcaaaatctttccaggtgattctcctgtgctgccaaggttaagaagcacaggtctagtgtagtagttccccaacctagctgccaatcagaatcaccaaaagagatttttaaaatacagattcctaggtcccagcccagacctacacaatcttgggaaactacagaggatgtgtatttttacagcatcacatgtatttctgattatcgactcaggggaccctcactgtaatgtcctcatgcacgattgtgatcttaaagcataatgcctgtagcagtttttatttatttattctcgtagacgaagctgtttttcactgcttcaagtttaatggccaagtgtgtttgtaattgtggttttttgttttttgctttttttgagacaaggtcttgctctgtcgtccaggctggagtgcagtggtgcaatctcagctcattgcaacctccgcctcccaggttcaagtgattctcatgcctcagcctcctgagtagcagggattacaggcacaagccaccatgcctggctaatttttgtagttttagtagagacgggggttttggcatgttggccaggctggtctcgaactcctgaccccaagatccgcccacctcagcctcccaaagtgctgggactacaggtgtgagccaccatgccgggcctcctgtaattgcttgttaagagaatcagacacctttctgaagccactaaccaaccagcagcattccccattctatgagcgcttttcctttctgctttcttggcacatttctgtcatagacctcgttctcagccttgttgagacacctcctttagtttagtgtggagtattttcctagaacaccgcagccagacgtcccccgttatccgcaggttgatttctgaggccaactgcagactgaaagtatgaaatggaaaattccagaaataaacagttcctaagttttaagttgcgtgctgttctcagtagcatgataaaatctcacgccttaccccatcctaacgcagacgtgaatcgtccctttctccagcttgtccgctgcgcagcgctccccgccggtgagtcacctagcggccatcttggtgcttagatccactgtggtgggatggaagtgcttgtgttcaagtcacctttattttacttaatgatggtcccaaagcacttagtgatgctggcatactgttacaatcgttctattttattattagctattatcattaatctcatactgtgcctaatgtataaatcaaactttatcgtaggtatgtatatataggaaaaaaacatagcgtacatagggtttggtactatccagtgggtttcaggaacccactgggggtcttggaacctattcctcatggataaggcggggactattgtactgaaatctgacaataactctgccatgatgcttcttttgagccacaaagggagccctcgatgtgccttgctgtggtcatttcctttaaattcccttgctgtgatcatttccttccatccagcccagcctgagatgtggagactaccagacagagcctcgtgtgatgctctgtcggcttgagtgtgaggaagcttgtaaatccatgcgttttgttaaaacattatcttctacagtgtcattgagggaagtttcaaatcagctgtgaaagaaaacaaaacccacccatctaaggcattactcatgcctggctgttcctggcttgcattagactccctggctggtcccttcaggctctccgttgagagctttctgtgaagttctttgtatattttcccaaatatgtttattatgggttcattttatcttctacgttggaaacgttatagattgagactcagtcactgccttattgctgcttttcatcatcccacccaccatcccttgggttaaccagagcaaaatagaagcaaactatattattcgcgaaactatagcagggaaaaagatccaagtttctggaacgtgtcctgatgaaaaaataagagtgcatcagatgtggagataaaatgtctcaatgttgaagggatgcatttatctacttaacactcagatgtttttctgatggaagcctctgcttatttatattttagcaaaggccaaactaacctgttctaagaaataatctcatactgaaagagagacctcacttcccatttcccaatccaaagtaaatgctgtgaaagaccaggaatgtagtaccgtcagcacacatctgggactgtttgtagcctacgttctgaaatcaggggatgctgacaggctcaagctgcgatactgaaaggaggcctggtttcccttctgttggaattacattacaaggagaaatattgatccagcatactcaagaatgggctgggtgtggtagctcatgcctgttatcccaacactttgggaggctgagacaggcagatctcttgagcccaagagttcaagacaagcctggacaacatggtgaaaccccgtctctacaaaaactacaaaaattagctgggcgtggtggcatgcgcctgtagtcccagcaactcaagaggcagaggtgggtggatggcttgagcctgggaggtcgaagctacagtgagccaagattgggccactgcactccagcctgtatgacagagtgagaccttgtttcaaaaaaaaaaaaaaaccctgaaattaaaaaaacattcactgggggaaaaattggtttcttagtagaagaataccagcaaaactcaaaatgaaaatggaaatgctctgctgccaatcaggaaaagactgaaaatcttggcagaattctgctggaatcctctgcccatttccttcatgttctcataattataaaagaaaaagaaatgaacattgataaagttcctgctgaataagagaagttttttctacctcacatttgttgaatgcatctcatttagtcatcaccctaaccctgtagggtacgtgttattatctccattttctttattttttgagacagggtcttgttctgtctcccaggttggagtgcagtgccgcgatctcagctcaatgcagctttgatctcccaggctaggctcaagcaatcctcccacctcagcctcccaagttgctgggactgcaagcatgcaccaccacacctgcctaaatttttttattattttgtagagacaggcctcactttgttacccaggctggtctcgaattcctggcctcacatagtcctcctgcctcggcctcctgaagtgctgggattacaggtgtgagccaccacacccagccaattcccattttaaaatgaggaaaccaaggcttgggttcggtgatttgctgtgactgaaaatccttccctccccacaaatagggacaccactatcagatatcacatagatcatttcccaggagccaagggcaaagggcagacccgtctttggccaaagccaaattctttcctacacagtaaatatgggaaaaagagagacttcaagcttcaccccaagagttgagacattttgaagaaagactgacacaattaggggagtcgctggatataggagtgaagtgcgagagaggtatcaaatatcaggctctggcctatgcttggagaaatggtgcaaaaccgttagcagaaatatggaaccggagtgcatgctgatttgagaggggtggtaagcatccaagtggaaattcctcacagactcttgagctgagactgaagttcaggaagaagaacacacctggattttttttcttatgctaggcattatagttgcttttatttcatctcaacaatcttttgaaaacgtattatcatcattcacatattccagatgaggaaactgaggcttacagaggttaactgcatcttccacgtccacagtgctagtatagaaaatgagctttgttgtaaacaggagactgccttactttttttgcatttccgcttgtccattaaatattttattgcctgtttagattacagtcattggtgcctacagcagcattatttatctttcattgggaattagggccttaaattaaatcgttagtcatattttatgtttttataatgttgtagagattctagttagggcatggtattctaaaaaggaaaagcattgatttaatttataatgaataattgtatctaaacagtgtactatgtgttctgcgttcaaataagccagaaagcttctatttataccaaaggaataaacagcaaacaacagacatacttaaattgaaaacatgagcacatttgaattttatttttgaatgtagatgtaattgaccatttgttctgcaaacaaggctttggtccagtttagggggaaaaaaaaatcagtgcactagtgtggagtattttctaaaagaagacaattttagagacttagtaaactttctgaaccggtaagacttgaaatgcctcatgaagggaagtgaggcagggaaacttttaatgagagattattccattcaccatctttgctggagctgactggtgtctatgatgcaggaagtaacctgagaaagaattctagggaggaaaatgtgttttttttttttctttctttcttttttgagacacagtctcgctctgtcaccaggctggagtgcagtggcatgatctcagctcactgcaacctctgcctcccgggttcaagtgattcttctgcctcagcctcccgagtagctggaactacaggcacgtgccaccatgcccagctaatttttgtatttttagtagaaacaagatgtcaccatgttggccaggatggtctcgatctcttcatctcgtgatccaccagcctcagcctcccaaagtgctgggattacaggcgtgagccaccatgcccagcctgaaaatgtgatttttttatgcagatgaaaataggaccacagtgaaggaggtagagaagagggcctttcttagaaaataatcggaacaaccacagccagtaattgtaggtcttgagtacgccaggccctcatctaaattcttcttatgtgtgaactcacagcaagcctgtggggtaggaactagtattattcccactttggagatgagcaaactgaggcacagagaaatgaattagttaggcctggttagtacttagatcagagaaattaattaacttgcatcagatatacacagctgaggagtaaggccaccaggattccaaatcaggtggcctagatcccaggcctgtgctgtttgctgcagcagtcataggaggtagtttgaactggaaagcagttcatcatgagaggtagcattttttgaggcactactgcctgcttgcatgctaggcactgaattgtcccatgcaattctcataacaacttcatgaaataaggcgtattactatcttcatttttttttttctaaggcagagtttcactcctgtcgcccaggctagagtgcaatggtacaatcttggttcgctgcaacctccacctcgcgggttcaagtgattcttctgcctcagcctccctggaattacaggcactcaccaccaagcccggctaattttttttgtatttttagtagagacggggctttgccacattgaccaggctggtctcgaactctggatctcacatgatctgccccccctcggcctctgaaagtgctgggattatatgtgtgagccaccgtgcctcgccatactatcttcattttcttaaagaggaaatcaaagcttagaaagttgaatgggcccggtgctgtggctcatatctgtaattctaacactatggaaagccaaaatgggaggatcgcttaagcccaggagtttgagaccagcctgcacagcgtgatgaaaccctatctgaataaaaaagtttaaaatgtagctagatgtggcggcacaagtctgtaatcccagctactaaggaagctgaggatcacttgagcacagggaggtcgaggctacagtaaactatggttgtgctactgtgtccagaattaggtgcgttcttggtctcactgacttcaagaattaagccgtggacccttgcggtgagtgttacagttcttaaagcggcatgtctggagttgttcattcctccctgtgggttcatggtctcactggcttcaggaatgaagctgcagacctttccggtgagtgttatagctcatacaggcagtatagatccaaagagtgaacagcagcagcaagatttattgcaaagacaaaaagaacaaagcttccacagtgtggaaagggatcggagaaggttaccactgctggctcgggcagcctgcttttattctcttatctggccctacccatgttctgctgattggtccattttacagagagcccagtggtctgttttgacagggtactgattggtgcatttacaatccctgagctagacacaaaggttctccagggccccactagattagctaaataaagagtgtcgacacaaaggttctccaagtccccaccagagtagctagatacagagtgtggattggtgcattcacaaaccctgagctagacacagggtgctgattggtgtgtttacaaaccttgagctagatacagagtgccgattggtgtatttacaatcccttagctagacataaaggttctccaagtccccaccagagtagctagttacagagtgtggattggtgcattcacaaaccctgagctagacacagggtgctgattggtgtgtttacaaaccttgagctagatatagagtgctgattggtgtatttaaaatcccttagctagacataaaggttctccaaggccccaccagactcaggagcccagctggcttcacctagtggatcttcacagaggcagtaggtggagctgcctgccagtgccgtgcgcccgcactcctcagtccttgggtggtcgatgggactgggcgctgtggagcagggggcggcgctcgtcggggaggctctggctgcacaggagcccacggaggggcagggggaggttcaggcatggcgggctgcaggtcccgagccctgcccgccagaaggcagctaaggcctggcgagaaattgagcacagcggctgctggcccaactgctaagcccctcactgccctagggccggcggggtccgccgctgctccgagtgcggggcccacggagcccacagccacctggaacgcgcgctggcccacaagcaacgcgcgcagcccgggttcccacccacgcctctccttccacacctccgcgcaagctgagggagccggctctggccttggccagcccagaaagaggtcccacagtgcagcggcggggtgaagggctcctcaagagccgccaaagtgggagcccaggcagaggaggcgcagagagcaagtgagggctgtgagggctgccagtatgctgtcacctctcactacactccagcctgggtgacagagtgagacccggcgacaaaaaagagggagagaaaattgaaagactttcctaaagtcacgagttatcaaatgccagttagcccggtctaacatgacactgaatcaactatgtgcttcctgctcaggagtcagaacgatattatcaagtgttaatgcttctaaatgcaaagagggagcaaggtgtttcttctctttagtctgtgaccagcagctgctcactataacctctcttccactgcatgtccaaggattactgcatagaggaggattcccatcttcccagcccctaaatttaaaaataaattaaataggctgagcgtggtggctcagggctgtaatcccaagcggtggctcactcccactttgggaggccgagatgggcggatcacctgaggtcaggagtttgagaccagcctggccaacatgatataaccctgtctgaaaaaagtacaaaaactagccaggcatggtggcaggcgcctgtaatcccagctactcaggaggctgaggcatgagaatcgcttgaacccaggaggcggaggttgcagtgagctgggatcacgtgactgcgctccagctctggctactgtctcaaaataaataaataaataaataattaaaagaatatagaaccgccctcacacttcctgccggatgcagtcaatttgacagtgtgcctcattcagagggtgttgcctacatccagggagtgtcaatttttttttattgaatgaatacctgattaagttaatgacgctgagctgggggaggaggagcagtttggcagcccaatgctgaagggcttctggcagctcattcagtgtccttaatgttccattggctttgtgctgggccgcatgtgagccccaggagaggctgctgtaattactcagcttttttattgaaaacagctgcaggtagcgagtcatcccattgtccatcttgctagtgactggaaacaactcggggccatcttgggctccactacactgcagcctcattctgaagtcagtggaggtagaaagtaggcttcccacttgctgggcttttcaaaatgagccattcatcttttgagggtcagaagtcagccacccattcaccgagtgtgagtcatacccctaattttaaaacaaacatttattgcagagagaattcttatcttggccgatgtgtacagctgatctccttgtccttcctacgattgatttaggctggtttcaacaaaattgttgtctttgtaaatacacacctcttccagtaaatccagagactaccgaggtgtttccttgagattgagcctaagacaatctttaattagttttggataattggatatgaatgtttagaggccttcccatatagcaagtgtctttaacatctcacacaatatattatacttgtacttcctgacccgagaagtaacaggagttaataatctcacgtgagaaagtatgtttgaaatggaatctcaaggggcagattctttgcagataccacaacattattttatgtccctccgtaatgagttcagttttttatcatcacatccaaaatctagaaaatgatccagaaatcctttgccttttaataaccagcttgtaaggaagacaaactgcaagagatggacacaagataagaacagtaaccaaccaaggacggacagcaccctagaaacccaaggggttgtgaacttcagtctctaagcagcatcggagtttacggtctaatgacgaaaacacgtgaaaacaaggattgcagcagccggaagtggctttgctgagagtttaggaatgattgcctaaggaagtagcagttaggggacccactgtattagtcagggttctctagacagacaggactaataggatagatgtatatatgaaggggagtttattaaggaatattgactcacatgatcaaaaggtcaagtcctacaataggccacctgcaagctgaggagcaaggaagccagtggttgaccagtctgagtcccaagacctcaaaagtagggaagccgacagtgcagccttcagcctgtggccaaaggcccaagagccctggccaaccattagtgtaggtccaagagtccaaaagctgaagaacttcaagtcgggtgttcgagggcaggaagcatccagcacgagaaaaagatgaaggccagaagactcagccagtctagtccttctacgttcttctgcctgctttcattctagcctcactggcagctgattagattgtgcccacccagattgagggtgggtcttcctctccaagcccatgacccaaatgtttatctcctttggcaacaccctcacagacacaaccaagaataatactttgcatccttcaatccaatcaagttgacactcagtattaaccatcatgcccaccatggtgaaggcatgcgggggtggctggtgttagactaattggagccttggaggatagtcgaggaaacggttcctgaacggtgtgtggatgagaatgttggagcagggtgctaaggaggcacagaggagaggcagagggtatggggttggagtggggagagccttaaggaggtgacatggaaggagagacctgaaagatgggtgaggccagtgcttctggaagtgtggttcctggaccagcagcatcagcagcatctgggaactccgggtgaatgtgatgcgcacgctcgagtataagaaccactgcattagaaaacaggtgacagtgccttgcggaggagcggtggctggtgtggaaagtactctaacagagcagagggaacacatacccagaggcctgcagcaggcatatttgaggcttgatcaggacacagccacccacacccactggttacaaattatctgtggttgctttcagcctgcagaggtagagctgagtaatggccacagaggtgtatggcccgcaaagccacacgatttactaggtggccgcgcatcgtcaaggttttccagtccctgattcagagggtggaactgacataacctgatgacagaatcaggggagaagaggcatacagggatatcggccagctttcagtcttcagtgagcaatgacatgatagagcagtgacactaagatactgctgcctcactttttacagctcacagtcccctttgcggatgtgagaaagggcatacagctttaagggcttaaaggatgccctgacgtccagtcctggaatacaggctaatgccagcaggtatctcagagatccttgtagctccaagcagatgagggagcggggcgctgtgtggtttcaaaacagaaatgcagtttgttcacaaacttttaagatcatgacatatttatttatttatttatttgagacagagtctcgctctgtcacccaggctggagtgcagtggtgcgatctcagctcactgcaagcctgcctcccaggttcacgccattctcctgtctcagcctctcgagtagctgggactacacgtgcccaccaccacgcccggctaattttttctattttttagtagagacagggtttcaccgtgttagccaggatggtcttgatctcctgaccttgtgatctgcgcgcctcagcctcccaaagtgctgggattacaggcgtgagccaacgcgcccagccatgacatacttatttttaaaaatttttgactggtgacaaaatatgcataatatgaaatttaccatcttaatcatttttacgtgcacggttaagtggcacattcttgttcaaccatcaccaccatctgtctccagaatgtttccatcataccaaactgaaattctggaaccgttaaacaactcccattgccccgtcctcccagctcctgctaacgcctgttctacgctctctccaaatttgactattctagattcctcatagaaggggaatcatatgatattgttcttttgtgtctggcttctttcacttagcataatgtttgaagatttatcaatgtcatagcatgtaacagaatgtcattcctttgtaaggagagggggatgaataatagctcgtcataaggatataccacatttttaaagtttattcatctgttgatgatcattgggttgttgacaccttttggctcgtgtgcacaatgctgctatgaacacgggtgtggaatatctgagtccctgctttcagtgctttgtggtagatatccagacgtggaattgctgagtcatgtggtaattctgtatttcacattttgaggaactgccaaaatgttttccatgcagctgcatcattttacgttcccaccaacgatgcacataggttctcgtttccccatctccaccaacacttgctattttccatttttgttttgtttttttttttaaaaaaaagaatataatgtccatcttaatgagtgtgaagtggtgtctcattgtggacatagcatataattttaagtatgattaaaggaggttagaacacgacttttgtgttggcaaagtggggaaaaggattggctgctgtaattaaaatcactgagacaggccgggctcagtggctcacgcctgtaatcccagcacgttgggaggccaaggtaggtggatcgctcaggtcaggagtttgagaccagcctggccaacatggtaaaaccccgtctctaccaaaaataaaaataaaaataacatagccaggtgtggtggcaggcacctgtaatcccaactacttgggaggctgaggcaggagaatcacttgaacctgggaggtgcagtgagccgagactgcacccattgcacaccagcctgggtgacagagcgagactccgtctcaaaaaaaaaaaaaaaaaaaaaatcactgagacatactgccaaggacagatggagttagggggcttaaagatcctctataccagccgggtgcggtggctcacgcctataatcccagtactttgggaggccgaggcaggcagatcaagaggtcaggagatcaagaccatcctggctaacacggtgaaaccccatctctactaaaaatacaaaaaaattagccaggcgtggtggtgggtgcctgtagtcccagccactcgggaggctgaggcaggagaatggtgtgaacccgggaggtggagcttgcagtgagccgagatcacgccactgcattccagcctgggggacagagcgagactctgtctcaaaaaaaaaaaaaaaaaaaaaatcctctataccagaggttctcacctctggctgcaaattagaatcccctggtgcatttcctaaaatgccagtggtggtcccaacatctagggattcttattcagttggtctggggtagatctggacattatgtttttaaaagctccctgggtgagtctgatgtgccgtcagcattgatttcttattctgcaggtgagagagtatggccctagtactaaggctgcaagggttctggtctctcagccagagctgctgccactgatacaccattattcagcatgaccacaaacacagtgaaaccagtagtgtcccaggtacatgtgcatcctcctttgtattgtggaggaaatatgtccccaaaatctgcagagccaagtgcgggagccaactcctccatttggtctgttgggatgttcagtattctatggtagatttctagtaagtcaatttcactcagtgggctgaggatattaagacaccggaagttagctgatgtgttcccccattgctccaacactttgaactctgtaccccaaaaattgatccactcagtgcttcttacatgtatgtgccattggggagatttccacagggaggctttctctgagcctttggccctggtgacattacactgagtaatatatatccctgttcctttctgtaccacccatctgcctgttccctggccacagtttggggtataccaatttagattaacctaattattgtttcacaaggcattcttatcactgaacgctgatggatgttacttcaacgttgttatattttattacttggcctatttaagtgtataaccatcactagctataagaaggtgaccaactacaacgttagagagagcagtgcctgcaccacgaattgcaagttcagggggtttcccagaccaccctccgttttgataattcagtaaaaggactcacagaactcactgaaagctgttctactcatacttattacagggaaaggatacaagttaaacttagccagggtaagaggcatataggagaggtctagaggggtccagacatggggcttctgttgccctctgcccatgaagtgatgaacagcattacctcctcccagccatgatgtgaagaatcaccaaccagggaagctcacgcgaacctcagcatctagagtttttattggagctcaattgctactgtcctcatgactgacctctagtccctaggccctcctggagatcaggcaaatatctttcattattagttcctctgaggttggaacgtatacctcatggcccaaagcccccatcataaatcacattgttactccatccagtggccaataaacatacttctgtgaggcaggacattccagaggccgagagatcacctccccacaggtgggggcaaaggccagacctgagtttgggtgaggttaaattcttcatggtcaggcgcggtggctcatacctgtaatcccagcactttgggaggccgaggtgggcagaccgcgaagtcaagagatcgagaccatcctggccaacatggtgaaaccctgtctctactaaaaatacaaaaattagctgggcatggtggcatgcgcctgtagtcccagcttcttggaaggctgaggcaggagaatcgcttgaacccaggaggcagaggttgcagtgagccgagatcacgccactgcactacagcatggtgacagagtgagactccgtctcaaaaaagaaaaaaaattcttcactacacactaatgacccactacacaacccaagaactagatcccaagttttcatattaggattttttgtgtgttgtttctgcccttttttagccatgtaatcttaggcaagtgacttacactctgagcttcaatgtccttgtctttgaaatggggtgatcatatgctagttgttatttatatgtaaagcattgctgtagcctgcacaaattaagcatcgtgacttgtcctgcctgctgtgccttagagagcctgggtcccgggaggtcttggggtctttgcagttgagagcattgaattgtgcagtgtctcagtgactgaaaccaccatagaaggtaagccagtgtgtgacacctggaggaacagctggttagtttatgaattatctggaggcattggctttgctttcattcagccacaccaaggacagtgaatagttttaagactctcccagagtacctcagttcccacgagacctttttcctgacttgatggagagttttatgttctctgttgtagactggggctgtctaatgtcctggaaacccagccccctggtggctggcaggatccagcctaggcctcctggagcagttgctggcgctttgcatcgtgttgtgtggtgaagctcgtgagtgtgtgtgcgggtagacagctggcagccttccctgcgggatgtggaaggaggattctgcatttccccaccatgcgtcttgggaattactcatccaaaaagtattgtggaaaagcaggcagagtgaaacacggaggcattgcacttaacccttccctggaaatgccatccttgagtttagcgtctgagctttctgtttattctgcttgtgtgctgaattgccttccttcttgttggtgtgcataggggtctgcacattgggcacttataaatattatcccacctatcaagtgaagaaaaaaatgaactctcaaacacccatcacttcctctttttctatcacagatgtgaggaaaaaacagatgtttgaaagaattgatagtttgaaggtgttgtattgattacatcatggccaggagagatgagcaacagataagtgtgggtgatcactgagaattcatgaggaaatgtttattgaattataactacgatggcgaccatgtactgagtgtgtgttatactaggcactgtgcatgttaattcttccccattttaaaggcagagattacaactttacacattgttgaaatgaaatttttgcctcattaaacttgggcacatgtataatcgcaagtaaaattaaaattattattttgagatggagtctcgctctgtcgcccaggctggagtgcagtggtgtgatctcggctcactgcaacctccgcctcctgggttcaagcgattctcctgccttagcctccctcgtagctgggactacaggcgcctgccaccacgcctggctcattttttgtatttttagtagagacaggatttcactgtgttatccaggatggtctcaatctcctgacctcgcaatccgcccgcctcagcctcctaaagtgctgggtttgcaggcatgagccaccacgcccggccaaaattatatttttaaaaatggataacataggtggtttggggtaaagccaaggtttgaacctgttctctaccttacggcgtagcccactctaactacaattctgtgtgtccttagtagtaatagcagtggaatattattgatctattatcatcattgttagtaataataatattaatatttatcttgatattctaaataggacagtggatgtgaatgcttcatgcatcgggtagtgagatctatcacagtggtggtaagaaacattcaagtgagagtcaaagtgacaggttctcatcctcctgaccccagttcttactgtgttaccttggccaatacttttcatcttcttgcatcagtccttgaaataagataatgaagagggctcacttcctctcactttgaaacaagttagtctggactgggatgagaaccactaactccaggcagcgtggaaagcatctgtgtaactgttcccagccttcaaccagagtggtggataaacagaaacgtgggtgcccccgggtagctaacctggaatgcactacgctttaaagcaaaaaagtatttgcttctgtattgaatcaggaaaggtcttgacagaaaggcatttccagcttttcttaaaaactccaactcaacctctgtcagacaattcatttgggaccagcttggatccagatggttatttttccatcttgagcctttccaggaattccggcatgggcaggccgccagagacactggctacacagccactgcagcgcgttttccatgtgagccggcttctagggatggcccagccaagctgtggccccgcccctcctccttcctcatccaggctgatcctccagctctcacggacatgtgccatgagccacgcagggggaccccagccacatggccgatgtcctgatgtttccaggggtggcagagctcactaactgcacccccagaactgtcatctgctcactacgaatagcaatggcagaagccaggaatctaagaattgatgaagcctggccctccattatgtggacaggtagtagcaaatcactcagccccacttagggataagggagacagcaacttaaccacgtgccaagcagacaagttcagcagaatggcagccagtgcagctgtgtgtcttgaggaattctttccagcctccccttcaaggcccttaatcaaagaacaactccccactggacgcagagctacccaagccagcgaccacccgaatgagactattattttgggtggatttaaattttttaatcattgcttcaagtatagtcgtatccattgcccaaaaagtctatagatgcatggggtcaaaaaacactactattcgtggtgctgataatataagtagtggggctgcttttctcctgcctttgcttgacccactgcagtcccagctggcagtggtagtggcagattcccctgacccaaccacccccaggaaggtcttgcctcaaagaaaaggaaaatgtggtgtgtgctgctggctgccacggactcaggggagcctgtgccaggttgcaggcttgaacttgcttcttgtgacactagagggagagagcttgtttcaaaagcatgttagtgctctcagttcctcacgtccgacctgtgccagaggctccttctgcagtctcaccactcctatggcctggatcacaattgggtgggtggtcttgaacttggctgctgagcctgaggtcccctgcttgcttgcctgggaaatacaaacatcctgacctctcttccttggtcactgatcagtctcttccttactgaacgtctcaccagctgcagttcttgattagtcaacatggtgcagaggtcccctagacatcttttcccctacttatccctgtgcattctgtcccttttctacatgaaaaataaataggcatatttgctatgaggctgccatcgccatagccaggaggtgagtgtaacccgcatcatggttgggtagactaagaaagtgatttccagtgctagttctacctctgactgtatggccttgggaaaacctcagtgtccttatctggaaaatggagataataatacaaacctcacaaatttgttatgaagagtaaatgagatatttaagtaaggttcttggcatgtataataagtaatcaataaatggaagatatttggattggtttcttagggctgccataataaattaccaaaacatatcgtggcttaaaacaacagaaaagtattctctaacactcctggaggcttgaagtctaaaattaaggtgctggtggagccatgttcccttcataggctctaggggataatctttccttgcttcttgctgcttctagtagcttcgggtgatccttggcttgggactgcgtcattccagtctctctgcctctgcctccacagggcctttgcctctgtacatctcacatctttctctgcctttctcttataaggacatttgtctttgaattgagggcccacctggatcatccagcatgatctcatttccaaatccataattacatctgcaaagaccctttttccaaataaagccattcccaggttctgagtgggcataacttttagggatctaccattcaacccactgtccttccttattcatgataaaaattaagatacataaaattatttattttttatgtccttaggccctcgtgtggactccttctagcttggattacgagctttcatttcttgctttttctcttctcactcactacacttccgtgaagagcaagatcccatgtcccaggggtgcagagccgagaagggaaacccgagcgcgttggggcgaggctctcagacagcatcttctacaaagttgtgccaggtcccagctcgcctctctggtggtttctggcctggatgtctctagacagggccttcagtccccttcaggagcctcctcattttgggccaagaggcctgccccatgaagctccacgcttagatagacatggaagagaaggtcaatagtcagtttccactgaggacacagcaagaagaaattgtgacagtagactgggatgacaagccagccaccttgacacagagtggaatcacagtctcagaatgttcctaatggcaaaaaaatgtagagtaagtagttcgaacacccaaccagggcagggacccctaccccatatccctgagtttctatcctgacccttggggtgacccagagatccctgactcatgaggcagcccagtccatttttaaccattctcattgcttcctaatgctgcagctttttctgttcttccccagggcactcattcccagttgtctcagctgttactcatctgcttgcctccagacctcttgcgcaactgatcactccccctagacatgccccatccttcccacgtgcctttgcagcaggatttcaactgtggctttacccgtgccatctatggttgcagtatttattcccttattctgaacattgttttctttctcttttcttgagacagggtcttgctttatcacctaggctggagtgcagtggagcaatcatggctcactgcagcctcaacctcctgggctcaagcaatcctcctgccttagcctcctgggtagctaggaccacagatgcaaaccaccatgcctagctaattttttttattttttgtagagacaggatctcgatatgttgtccaggctggccttgagctcctgggctcccaaagtgctgggattacaggtgtgagccactgaacccagcctgaacattatattttttttaatgaaggttataattactatactttttaagaaccctaccaaatggttgttcatattgagtgtatagtcaaacaaaaactttctgggctctttcattgaaaccattattaaaccagatctcttcaaccctgctagtaggctaattgagctgttgaaaccaagggcaggcatttacatttattctcattgatcttaattttcctggtttggtaccatcacttccggcttcttaagatatatttgaatcttattcgcaacatatatcccttctagccttctgttacttcgaaatatgataaccaaaacactgtattagtattgaatagaacagaactaaaaatagagttctggcataccatttgcttcacactgacattgaacaattgaggtccccgtcatacatactagaaacggaatgagtgtttgatgaatgaatgtgtgatccactttgggggcatgcctgttcagtcaaccataaaggcatctaattatagctatcatccaatccacctttctccattctagatactccaagcatgtcgggtttggacctgtttttaatgcttggccaaaatgaagtgctttctgccagtgcaccacacaggccttccagtttagtgatgtaataaagctggaaggagattggtgagtcagcactttgagaatccttgacatgcccaagtaacctctgtcctcacacccaggtattctgccctcttcagtgtttgcatacgtagtttttccagtcctggcacaagctcatcagcctgctcttcctcttctttaaagctgaaaccgtgccctgtttgtccatagatatacaggccaggcagccatgggttcattcaaactgagaagcacaggattgggggtgtaggaaaagcaacccattttcttgccctaggtttaagatgtatttttaggagtttatatatcaaattctaagagcatcttccattctgagcagttggctgctatttactggacttgcagtcagtgggcatatattccccacatccctagcacagaagcatctcattttcctatcacttcccaagcagtctgaatccatggtaatagcaaaaaatttctcgaaatgaaattatagcaaagaaagaagtgtggagcttcctttgttaaatttcatttttcttcctgggaatgattgagttgtgtataaaatttatgataatagcctttttaaagtatatttctctgcagttgtgtaaagaaccagaagaaaagcagcatttgttatttgcagccgtattaggtttagatgaccccagaggaagcagtggagcatcacctaaatattagatgtttatctccgaggctccatcaactctgtgtttacgtacaacacctagtttggtttcccagtgcctgctccattaggaagaggctagagatgtttaatttgcttaagagtttagcagtagaaaatttaatcggatagctgctagggtttctcaaaccttactgtgcatagaatcatctggatatcttgttaaaatgcaggactgggtggggcctgagagtctgcatttccagcaaacttgcagaggatgctgatgtcacgggtcggaggaccacacttcgactagcaaagccttataccactgggctaaatttagaaattatgatagagagatagttaatgtagctctaaagcggcttaagatgaatgtattcagaacagtgattatcaggcaaaccatgggtagcaaactctaaatacatttgtcttgattcatctattaactctccctccaatttcccttttccaataggaatgtttaaacagtgcgatctgcatatgtggctctctggtaatttggcattgatataattgtgcatggccccatgtttggaagaaatctttttgttgtggcaggtgcttccagagataaactcctcgggggtcccctgggagggcaattcaggacacagaggccagttgtctgcaactagagactctaagagcagaaatcccactctccttttttcttttttcttctttcgtttctttttctctcttccttattttccaaatctacttttccaccttcataagttacttctttgttgtttagtcccatgatcacccgatagaccaggaatgtggtgccatcctggggcgccctctggtggttcattgaaaatacagcaagacccaatctctacccgtgggtttccccttatcagtactgaaagcttacggggcccagagaagggacacatacctcagcgttagagagccctgtctgctccgtgctgcactggtaaatagccctaaatgtaggaggaggatgggtggaaacttttatcggtttggccccagctcgctgcaactgctgtcttaatcattgtgtccttgatttctcattggcaatctctggaaaagatgctgtttatcaatggataagttttcagaagaataaatttggatttgtgtgttaaggccaatatgtcttagcaatcatttcgcagaagaccagtccagtgagtcttcagggctgactaagccgatgtctctcaaataaacagtataattaaacctgagcactactgagaaccaagtcagcattctttttcaaatttacgaaagctggcttcctaaagaagtaccttcagaggagttttctagttttgtgtattgtgcattcaattgtacaggcaatgttacatttgcattgctaatagacccttcctgaatgtgtttgacattttacttggctttgaaaggacttttatgccgctgctttttcttccctagtgctgccttgggctaattaacctattcccttactggctgggcctactatatgcaaatgttctcattttgcattctgacacatcactcttgcataaatatccctcatgaaaccctgtggggttttattggatcagtgctgcaggagggccagcagggggcgcatggactggttctctctgagtaggtctcacgcatgagttttccttgctcgttggtatggaaatgtgggagcgtttggcattccctttcttaagagtgagtcttgaaatttaaagataaaagttcattattagaacttctttttacaagggaaggctgtacagaacacagttatttgtcacttacaaaaaccctaggtgggcagggcgcagtggctcacgcctgtaatcccagcactttgggaggtagaggctggtggatcatttgaggtcaggagttcgagaccagcctggccaacatggtgaaactccgcctctactaaaaatacaaaaattagccaggcatggcggcagccgcctataatcccagctactcaggaggctgaggcaggagaatcgcttgaacccgggaggcggaggttgcagtgagccgagattggcacattgccctccagcctgggcgacagagtgagactccatctcaaaaaaaaaacacctgggttgcgagagtaaataagtgacattactccttcaacacttcatttcttcagcataagtgttttagggtttttttaaccttatttttcatttccgtcccagtctttaagcgcctctcttgtcatatgagaaattctattcttactgaaatgtcctttgatatcgagacaccaaatttctaaacctgcaccttcctagatatctgatcaaaatcattaaggattgagaactttctgttgtatcatttgtcatttcattatgatgttcattgatgatgttggagcaaaaccaataagggccattaaatcattgccccttccaagctggctgcagtggctcatgcctgtaatcccagcaccgggaggccaagtgggtggatcactgaggcctgttcaagaccagcctggccaacatggcaaaaccccacctctacaaaaagtacaaaaattagccgggtgtggtggcgtgcacctgtagtcccagctacctgggaggctgaggtgggaggatcacttgagcccaggaggcacaggttgcagcaagccgagatcacgccactgcacttcagtctgagcaacgaagcaagaccttttcaaaaaaaaaaaaaaaaaaaggaaggaaggaaggaaaaaaatcattgccccctctaaaaaatagttacaaagtagggggcagagtagagaaagggggttatgtttcagtagggatttcagtgttgctccaacatggacaaggattgaatgctgaaggccgctactttattgtgtttgttttaaaatcggatcattggctacacacagtggctcatgcctggaatcctagcactttgggaggccaaggaaggaggatttcttgaggccaggatttcaagaccagcctggttaacatagcaagaccccatctctccaaagaaagaaagaaagaaagaaagaaaatcagatcattgaaaagagggtctggatgtgagataccaaaacccaagggtgtggaattcccaaagcccaatcccacagctctcagaatcacagcatgttgcactgtgcatacctacagctgctacctgtggaagcaatcacatccgctgcttgctagcctgggtcatgtcagttccactgatatttggcctcttgtctgttgggcattggtttgcccacacagcagcagtaactcagacttcagtggttagtaagagactgagatacttgaccataagaactggctccagggtcaccatttgtatgtccaggtttgaacacactgatctgatttgtctgaaagagctgtcgtctctagtgttaatggcgagttgttactttccaatgagaaaggggacggtgtgaaggggaacttcaatgacaacttgaaaaggaagagagagatggacaaaccaagcatgtaacccactgagaaaacattcagtgcactagccctatttttgtatggtatttgggttttttaaccataatcaaattcggtttttaacagtctcactccgtcatcatatgagtggctgtactgggaattcttttgaaacttgcagagaacaggattatttctggcggcctctgctgagttggcgtgtgtgtgtgtgtttgtgtgtgtgtgtattagggagaggaaatcgtaggtccagtgtggacccagagctaaggggaatcttggagagtagtggctctggcagatgaggattcagaaatcgagtgcaaggactgttctggactttcactgctaacctgctttttctcagtgcctggctctgagggcagggtccagctggtgtcatgctctccaagggcttcattttatgttccagccaggcaaaggagaggtgagaaatggaaccaacatttctgaaaaggaaatttaagaactgcatcatctgcccttgaagaagaaaaggagaaaaaaaaacaggagagagggtattgagaacatcttaggggagttgttaactccattaaaaaatatatgtgttacagtgttcacttgcccagtgtcttcataatcttcctttataatgtgcagctgccacggctagtgtttttgtttttgttgttgttgttttgtttcgtttttggagacagagtgtcgctctgttgcccaggctggagtacaatggtgcaatctcggctcactgcaacctctgcctcctgggttcaagcaattctcctgcctcagcctctcaagtagctgggactacagccgtgtgccagctaatgttacaccaggctaaatttgttttttattttttatttttggtagagacggggtttcaccatgttagccaggatggtcttaatctcctgacctcgtgatctgcctgcctcggcctcccaaagtgttggctagtgttttctctgcttcagtgcttggggtatgattgggttatgggagttcacaccgagtccagggcctagtcttaatcttgccaaagatgttctttccccggtgctcatgttctgatgtcctttccctccttccctttctcctccctttccttttccctttgtcactgccctcttccctttcccagcatccagagctgctgttggcggattgtacccacggggagatgattcctcatgaagagcctggatcccctacagaaatcaaatgtgactttccgtttatcagactaaaatcagagccatccagacagtgaaacagtcaccgtggaggggggacggcgaaaaatgaaatccaaccaagagcggagcaacgaatgcctgcctcccaagaagcgcgagatccccgccaccagccggtcctccgaggagaaggcccctaccctgcccagcgacaaccaccgggtggagggcacagcatggctcccgggcaaccctggtggccggggccacgggggcgggaggcatgggccggcagggacctcggtggagcttggtttacaacagggaataggtttacacaaagcattgtccacagggctggactactccccgcccagcgctcccaggtctgtccccgtggccaccacgctgcctgccgcgtacgccaccccgcagccagggaccccggtgtcccccgtgcagtacgctcacctgccgcacaccttccagttcattgggtcctcccaatacagtggaacctatgccagcttcatcccatcacagctgatccccccaaccgccaaccccgtcaccagtgcagtggcctcggccgcaggggccaccactccatcccagcgctcccagctggaggcctattccactctgctggccaacatgggcagtctgagccagacgccgggacacaaggctgagcagcagcagcagcagcagcagcagcagcagcagcagcatcagcatcagcagcagcagcagcagcagcagcagcagcagcagcagcagcacctcagcagggctccggggctcatcaccccggggtcccccccaccagcccagcagaaccagtacgtccacatttccagttctccgcagaacaccggccgcaccgcctctcctccggccatccccgtccacctccacccccaccagacgatgatcccacacacgctcaccctggggcccccctcccaggtcgtcatgcaatacgccgactccggcagccactttgtccctcgggaggccaccaagaaagctgagagcagccggctgcagcaggccatccaggccaaggaggtcctgaacggtgagatggagaagagccggcggtacggggccccgtcctcagccgacctgggcctgggcaaggcaggcggcaagtcggttcctcacccgtacgagtccaggcacgtggtggtccacccgagcccctcagactacagcagtcgtgatccttcgggggtccgggcctctgtgatggtcctgcccaacagcaacacgcccgcagctgacctggaggtgcaacaggccactcatcgtgaagcctccccttctaccctcaacgacaaaagtggcctgcatttagggaagcctggccaccggtcctacgcgctctcaccccacacggtcattcagaccacacacagtgcttcagagccactcccggtgggactgccagccacggccttctacgcagggactcaaccccctgtcatcggctacctgagcggccagcagcaagcaatcacctacgccggcagcctgccccagcacctggtgatccccggcacacagcccctgctcatcccggtcggcagcactgacatggaagcgtcgggggcagccccggccatagtcacgtcatccccccagtttgctgcagtgcctcacacgttcgtcaccaccgcccttcccaagagcgagaacttcaaccctgaggccctggtcacccaggccgcctacccagccatggtgcaggcccagatccacctgcctgtggtgcagtccgtggcctccccggcggcggctccccctacgctgcctccctacttcatgaaaggctccatcatccagttggccaacggggagctaaagaaggtggaagacttaaaaacagaagatttcatccagagtgcagagataagcaacgacctgaagatcgactccagcaccgtagagaggattgaagacagccatagcccgggcgtggccgtgatacagttcgccgtcggggagcaccgagcccaggtaacgttagccagggtggcacagggatgggacaccacaccgtgatgccatcatcatctcctggcaagacgaattgcttctatgaggcaggattaagggttctcgggtacacctagaccttagactcggcctttcccaactgcgttctctagaaaaaataagccccatttccccgtgatctctgctgtgtgtaatgaattaacctccatgcatggagagtggggctagttatggagtccttgagacaatccagaaactcaccactctagttattttttgaattctgtgattaagatgaggaaccctgattaggaaacgctgctggacttcaggtccttctagtggtcattcggcactttttcttaccaggaaaagacagaggatgccgttggagtgaggggattagatgctaaagcaatcatatcccattgcaacatccatgttttaaaatatgtcttattagctgggtacagtggtatatgccttcggtcccagctactccagagactgaggcaggaggatcacttgagcccaggagttcgaggctgtagtgagctatggctgaacctgtgactatcactgcactcaagcctgggcaacatagcaaggcccggtctccaacatatatataatgtcttattatttaggtatgataaggccaacagatagatcagcagacaactctctttgacgagataatttttatactctctgatcccaagaggaaagggcactctacaccaagaggtgtagaacaccgtaaagtggggggcacctggggaagccccaggtgggtcaggaggtggagggagtgaggggaaatgtggcaaacaacagcctttattgtggtttcatgggaggcagggtaaacgggtttaggattggttagagtggataattccagtgtgctctggggtgtaggggctgtccttagttgtctggctgctggtgctggggtgatcaatacaggtggaagggctgggcacagtggctcacacctgtaatcccagcactttgggaggctgaggcgggtggatcaccagaggtcaggagttcgagaccggcctggccaacatggtgaaaccctgtctctactaaaaatacaaaaattagccgggcatggtggtgtgtgcctgtaatcccagctactccagaggctgaggtaggagaattgcatgaacccgggaggtggggattgcagtgagccgagatcaggccactgcactccagccttggacacacagcaagactctgtctcagacaaaaaaaaaaaaacagatggaaggcagccctaagtgtgatggaccaatataggaggctgctggggagtgggctctggactggttagtttgcatatgaaagtcaggctcctaggaattagctctggactggttggtttgcatataaaagtcaggcctctaggaattagctaatcctaggagagactatacctctgggatccacaagacactaaaatatcaaagcatcagaaaataaaagcgtggttaatacaatctgagaagtcagggctgtcccaggtgacctgctgggcttggggtaaagtcagctgtagccaagatgagtcactggaagtatggttaacgctcttaatttccacaggctccttcaatctacccttttccaggttcttagatcgattacatgcatttattccacagcccatttctttcactgcccaagttgctgggagtccagcaggttcagcctgcagctgagagctttcctggctatcgagcgtactttctacaagtgtttccatctaggatttgaaaacattcaaatgggacagagcctccttccagcttgagttgaaaatagtcatgaaatagctgctatttgggacattcagataaaataaaacaagaaaaaaaagataaactaattaatggtttgaattgttttgggcatttttttttttcatttttgagacagtgtttcttgtctcctaggctggaatgcagtggtgcaatcatagctcactgtggccttgacctcctaggctccagcgatcctcccaccccaacctccctagtagctaggaccacaggtgcataccaccatgcccagctaatttaaaaataaaaaacattttagtagagatggggtcttgctgtgttgcctaggctggtctcaaactcctgggctccaagcagtccttccacctcggcctcccaaagccctgagattacagacacgagtccctatgtctggcttttttgagcatttcttaaatgcccaagtgaggaaaggaccaaatcagttttccagaaccactcgtgaatgactggatatgggggcttgcacaaagccggggccctgcattgccgagagcttttagccctgaatacttttctttgtattatgagatgtcactgtaggtttacagtctttggaagggcccaagaaagatttccccaaagatcttatttaaaaaaaaaagaaaatcaggatttttaaaataaatggcataataatacagctcactacccctctgtagtggctgttcacttcctgcatgaattaggggtgggtactaggagaaagaaaatgaactaccttgagcaaagttgactcttcacagaccccaggtgacacatggaaaataaacatgagtgaagagtcattgcttttcatggtacttagaatccttaacacatttttgtgaacagaggcaggtgtgaaaagaggttttgtttagaaatgcgactggttccttgccggccagcatcaacttcagcttgagaatgaaggcagccacttcagctgtgggccacacttcccaggcctggcagcctctgcagaaaccagactcttctattttttttttttttttttttttttttttttggagacagagtcttgctctgtcacccaggctggagtgcagagtgcagtggggtgatcttggctcactgcaacatctgcctcttggttcaagtgattcttctgcctcagcctcccaagtagccgagactacaggcacacgccatcaccccctgctaatttttgtatttttagtagagacagggtttcaccatgttggccaggctggtctcgaactcctgacctcaggtgattcacccgcctcagcctcctaaagctgggattgtaggcgtgagccactgcgcccagccccttacagccctcttctgttcttggggaggaagatctaggtgtgtttttccctactccaaactttgcaaaattaatgattaaatgaaagagaaattggcttccctgtgaagtcagagccctgttctcatgttttttcccatagtgagatcactaaatctctctactgacagccagggtgcagacgagcaggtagaagtgttgtcagggcctgttggcaggtctgtgaggttggcccccgcgtggctatgctgcatgccgggaagggcttcctcaaagaaaggcaagtgtgctgagacctgctgaaaaggcagctagggcttcacgctgtagaaacaaaagtgcaaggcctgacgcaaccaatgatttgtcactttaccgaggagcctatcagaaatcggctgacatcatcacagctaaaatactccaccagctgtgtttgccacaagtgacaggttcagagtcagtggagactcagacagagagcatgagagggggagatgggagggagagagagaactcatatctggacttaattgaggttccaaaggctacatccttctcccctctgcagtgccttcctgaggggttttctcccctagcctgaagaatcttcctggtcttctcaactggttaggcactgctgacactgcacccacagagaaattcagaaatgtgcaaattgttgagcttaataagcaaaatcacaaatttgattggggaagttgtggaagaagagatggttttctccaaaacagatggcattgtgactctaggcagaaatcctgcatgaacagactcttgaggatgcctgaactcataagacccccccaacatcacacccccagggaaagcagtgtgatatagtatggtggtgacagacccaggggtgcggatttgggtctctggcaggacaagttacttcacctctctgagctgcagcactctcctctctaaaccaggcaaatgagttttgtttttctgtgggtttttgtgttcgtttgtttgcttgttttgagacagggtcttgccctgtcacccaggctgaagtgcagtgatgggatcattggctcactgcagcctcaacctcctggactcaattgatcctcccacctcagcctccccagtagctgggactatgggtgtgtaccactacacccagctaattttctgtgtttttttgtagagacagggttttgctatcttgcccgtgctggtctggaactcctgggctcaagcgatccacccacctcggtctcccaaaatgctgggattataggcgtgagccacggcgcccggccacgtatgattcttcataggagataatctcttgagagggttccgttttttaatgcttcacttttatactttccagaacagcacagcccttgtaaaaatttattagcgtcggttaacaaaaaaccaagaagagcattaagatgaacatgtactgacctcatgctaagcggcacacagacctcatgggaactaaagccatggcatataaaactgaggggtgtttagtttggggatgatttttaaggggctgaattcctcattaagactgtggaaagatgcccccagcattgtcccagctgacgctccagacgaggcaatgtaggagaaaaatgcttttccgtgtttgtcactatccctgtggcattgccctgcccagtacagcttttctccactcgagcaaagcgtctatgcatcccccaggcccccacctaggtgctgtgggaggaaaggggaatgccaggtgttgtccattgttactgcgtgcaccaaaggaagcctccttcctcttcagtggagggtgatagcacgttccccaccctggaagagagttgctgctttgccatgccttgattctggttgagagtcccaaaggatgacagaatcacttcccttgggcctcactgccaaatataatccacttaatatcctccaagtttgaggccataagtctgtggcgcatccagatgcgacccccgaggcgatagcatcaacgtgggagccaatgcaactcaaaagaaggatggggcttcgcacctcctccttgggtaggaagtaggttagctgcttggaaaatgcaggaactggcactgaagagatctgagtctgaacatatccctcacccgtcagtagcactgggaccttgtgcaatgttagttttcccttccctgcttcaacttagatggctcgggccctgagaaagtgattcacagctgaaaaataaatcaaaggcctcgtgttctaaaaagagtttatggaaggagaggcagctgatgaaagtctagaaagaaggctgaacttttccaatgagcacaataagccatttttaccctgcctgtaatcctcggggtggaatcccgcgagtggccgaggcgagcacccttcccgccgttcctgtttctaaggctaaatgatgtcatgccagcctgcgtgagcatatcaatctgtatttctgagtatgaactggatttgaggggtgcattggtgctccagccctccagatcagtaagacaaccaatgcagaaacaagggctcccaggctcctcttctgcaagaggctgttagtgacgtgcccgctgggacagccctgcccaggatggccccagctggggagcctttggcttccatctggcggcgttctatattatcccatccttctgtctcacccttcctaggttcagcttctctgaagagtacacagcatttgctcagtggagttgtaaaatgtattggtaaagtgctctgggttgacacgttcctttgcttctttcctaaatgccaggctctgtgttattagggccgtctgtcgcttcccagcgcctcccgaggtgactgcttccctgactcggtggctgcttaatattcagtgccatttcctcctcccgactgtcctggcgtgggtgtgagtgtgcctgtgtgtgtgctcgtacagcagttgttatcatgatgtacttactggctgtctaccgatggctttcctttcattctactattttttggttgacttctgtgagctgtgagtcatcggtggtaacattatgcattgaatggattagctggtacctaaaaatagccgaggccctcatgcaggcggcacatgagcctgtagagtcagtccctttgcagccaaggcagacccacttgccaacattgaacatgccgagcttggtggcgatgaatcctaatgtatcaaaaaatagatagttggtgactgccctgtgtgcagagcccagccctggatttgtgccgcagttgttggtaatacacacttcctgtctgttctggtgctggaaaggctccaacagagaaactatgtcaaaccacatttttgtttgtgggtctttgtacctctctaaaaaaaaaaaaaaaggagaaaaatgctctcctttaaactgtatgtgctatatgtgcccccaactgggtcatcttatatgttttgattctctcagactgttgttgtttatagcatttagaaaaaaattaaagactattgtttaaagcagttttaggtgtacagcaagtagagagaggtctcacacacctaacagttttccctgttattaaaatcttgcattggtgtgatagattggttacaactgatgagccagtaccgataccttatttttaactaaagtccatagtttatactacagttcactctgtgttgtacatgctgtttttgatgaatttatgatgtcatgtatccagcattacattattatacagaacagctgtaccaccctaaaaatcccttatgcatcaactatttgtcccccacaccccacctgaaactcctggcacccactgatcattttactctctccatagttttgcctgttccagaatgccatgcagttggaatcatccggtatgtcgccttttcacattggcgtctctcacttagcgatatgcatttcaggttcttccatgtcttcttgttgctctgatagctcatttctttttagcactgaatattatgttgttctttaaggcacattttttttttttgagatagggtcttgctctgttgcccaggctggagtgcagtgacaccataatagctcactgcagctttgacctcctaggctcaagcaatcctcccacttcagcctccctaggaacagggaccacaagtacacaccaccacgcccagctaatttttctatttttttgtagagacggggtcttgccatgttgcccaggctgctcttgaactcctgagctcatgtgatcctcccgcctcaggcccccaaagtgctgggattacagggatgagccacccttccctgcctaaggcacacattttaaggccccagaaaaggaaggcaagtgagctagaacctgtgtgcctaagggcttccgtgtcacagctgctgtggtcactcactgggcagtgtccttcctggccatccctgagcctccccacagggccttcccacaagggagctctgtgagccacgctaccatgtgtaagaaaaacccagcttttaatgtgggatttgtgttaggaggcgtcccggtgctagggtgtgggtttactgaacaaccctgaaacacttccaccaaggactgagtcaggctttgcgtgaacatgattcagtgttttaaatagaacactcacagagattcttacactcagccaaagcgttttgactgtttttattaatgatttttaaacattgcagtaaatgggtctctcgcttacccccttcatctttgagacggggttttctgatttttttcatgctgagaacgtaaccatgcagacttagccttccaggaaagcagaccggcctttctctacaggtaaaacaagactgagaatttcacttgcagacaaagttaagaatgcccaatttaataatttcgccaaaaaacaagacatacttactgaaacctagcttatgagagaattcattgctcccagcaacaggcgaaatttgtatgtctgggatagtgtcatgaaaaaatgttttgtaaaacagatgcccttcgcaatttgtgaaaacagggactcttgtgaaggaaatgggagacatatttaaacaacagacgttttgttttctttctatcttgtttttggtgatatgtacatatgtgtgtatatagacatagcaccaatctaagattgaaatatacaatcaaacagcataaatatgcgtgtatgtgcatagtgtttagatatagtagttattgactaagtggtgaaaggaattttattgaattttcatacagaggagctaaaatttttcttaaaagccagtcattagtcagattaggaaggtgacatttaaaaaataattatgagcccagaagtgagtcggtgttgtctccctgtctaggttcgtccatccaaaatgggagttggaggtgacagttctagaggagtcgatttagggggatggatggaggaaggggtaggcagatctcttataaccacactgatgagcacatgggcttgctggcagcagtgggaggagggagggaaagagtggaggagggtgggaggcggtccacccccaaaagcaagaggtgctggcgacagggcatccagagatgaaagacagagggccctcaagcttacaaaagtataaaggccatccctgggcgcggtggctcacacctgtaatcccagcactttgggaggccgaggtgggtggatcatctgaggtcaagagttcaagaccagcctgactaacatggtgaaaacccgtctctactaaatacaaaaaaattagcctggtgtggtggcaggcgcctataatcccagctacttgggaggctgaggcaggagaattgcttgaacctgggaggcagaggttaccgtgaatcaagatggcaccactacactctagccttggcgacagagtgagactctgtctcaaaaaaaaagaaagaaagaaagaaagaaaagttataaaggctattctacttactgcttagggtgtttgaaacaggatatatttactggatgaaaaaatgggctatattgagctgtctggcgttatgtaacgtgctttggttatctgtggtactgctcccatgagtttattttcattgggatttaatcagaaaccattctggaaaatgtgtggaaccccagcaagatcataaaatgacttaatgattactaacacagctgcaagaacgagagtggagagaaaataactgaagtgtgattcaataaaatcatgacgacctcagcatctgacaaggtgaggtggctatggctccgctgagaaagctgcctgttaggcggtaaagccacaccctggagaaagcactgctcctctccctgggggaggtcacagcccactttagttctggctggttaaaaaaaaaaaaaaaaaaaaaaaaaaagacaggcagtctctctattgccccctgttgtccacttgtaccattgcaatgtttttccatacagaaggcaaacagaactattctttcagttttttttttgttttgtttttgttttttttaagacggagtcttgcactgtcacctgggctggggtgcaatggcgtgatcttggctcactgcaacctccgcctcccaggttcaagcaattctcctgcttcagccttcagagtagctgagattacaggcacctgctcccacgcctggctaatttttttgtatttttagtagagacagggtttcaccatgttggtcaggctggtcttgaactcctgacctcatgatcagcccgcctctgcctcccaaagtggtgggattacaggtgtgagccaccatgcccggcctcttctttcagattttaactgagcacctattacttgctaggaagtcttttagactctggagatagaacactgagtttggggaaagaggcaaaacagacaaatatacaagtaaataaaaaagaatgcataagaagataaccagtcccttttggcaccagggactggtttcatggaagaagattttttggcaggatgggaagagggagggggatggttttgggatgaaactgttccacctcagatcatcaggcattagttagattctcataaggagtgcacaacctggattccttgcatgcgcagtttacaatagggttcacgctcctatgagaatctaatgcttgcgactgatctgacaggaggcggagctcagtctggaatggttgctcacctccagctgtgcagcccagtacctaacaggccatggactgctactggtctgttgcctgggggttggggatccctggtataaagaggagaaggggccaggctaggtggctcatgcttgtaatctcagcactttgggaggctgaggcaagagggcacttgaggccaggagttttgaaaccagccaggccaacatagcaaggctccatctctacataatgatcatcattatcttcaccaacaaaacattagctggacatggtggtgcatgcatgtggtcccaactactcaggcggctgaggcaggaagatatcttgagcccacgaggtcaaggctgcagtgagccatgatcatgctactgtactccagcctgggcaacagaacaagaccctatctcaaaataaaaaaaggaagctatggaaactagagggttgttattttaaatagaactgtcaggggagttctctctgaaaaggacagtgggtggcaacagtacgtgaggcaaaaaagattccaaatgaatggagagagtagcaggtgcccagacggaaggcgcaagaggggttaaagaaccagcaaggagaccactgttgctacagtgtagggagtaaggggcacatgcagaccacatcaggcttgcatgtggtgaccgagcgagtgagatgcagcttggccaggacaaaggtggtggaggtagtaaaaaaatagtatcattctaggtgtatttggaaaaggaacccatacagtttgcttataattgggatgtttgtgatgtaagagaaagagcggaagaaagtatgattccaaggtgcttgattgaacagccggaagaatgggataccatttatggagatggggaagaacatgggatggccaccgggcaggggcacatcgggaggtctggtgtgttttaggtcactttaagtttgagttgcccattcgacatctgagtggacgtcatcggatagtgtggtcactggtgtccaaatgtacccgttttgcgtgtatgttctgtctcctggtgggaggcaagaaactaggtcttaaccaatagatactcttctaaggttcctaacacttagcaggtgctcggtgtatacttgttgaacttttattaaaactggaaagcctgaaatgtatcattaggaaccctcaataatattttgaggccgggcacggtggctcacacctgtaatcccagcactttaggaggccaaggcaggcagatcacttgaggtcaggagttcaagaccagcctggccaacatggtaaaaccccgtctctactaaacatacaaaaattagccaggtgtggtggcttatgcctcccagctactcgggaggctgaggcaggagaatcgcttgaacccaggaggtggagtttgcagtgagccgagatagtgccactacattccagcctgggcaacagagcaagactccatctcaaaaaaaaaaataataataataacaatattttgaagctatcagcatcatagagaatacccatatgggttttaaattcaaggaattcacagacttattgttccagttgaagatgacatcatcctacaaaatcacaccgtctctgtttcacatccaaaccagtccccgctggcattgacagcatgttttgagatggagaaggctcctctccaagggaatttcaagcaacagatttgatgatatatattctcactgagaaacccctcagtgagatttcttcattaacggttaatgatcagttaacctttaagaatgtttatatccttatgacaaacctaattataaaataaagatagatttgctatgaatgcttgagtgtacctatttgagatgtgtgcaacaagattttaactttcaccaaagaagggaaaaaaaccttattttacttctcatacattcagaccccaagggggaaaaagtacattgtctaggtagttcacactaattagtgaggagaaaactagcattgggctggcaagctatccgatctgtgcctacaatgatcagattatctgaataatcttccgctcccacctcagctttcatggacccagctgatatctggtcgtggcatcttttcgcagggtgacacagctcctttggtaggaagcaaaggcagaatttaggcaaaaagaaacaaagagaagcctttgaagtgattaaagaagaatctcccaagcctatctaggttaacataaatttcattaacaggccaggtgggcgcggtgactcacttctgtaatcctagcattttgggaggctgtggcgggcagatcgcctgagatcaggagttcaagactagcttggccaacatggtgaatgaaaccccgtgtctactaaaaatataaaaaattagccaggggtggtggtgggcacctgtaatccctgctacttgggaggctgaggcaggagaatcgctcgaatccaggaggcagagattgcagtgagctgagatggtgccactgcactccaacctgggtgacagagcgagactctgtctcaaaaaaaaaaaaaaaattccattaacgtcatcttgttttagtacgcatctcaaatattctctctctccatcacttttctctcgtgaatttttcggcaggctgttctagctatggttcacaccacagcatttaattctaaggcctgtctttggagatttggagtttggtttggtttggtttggtttttagagacagagtcttgctctggcacacaggctggagtggtgcagtagctcgagtgaccctcgcacctctgtaactgaacttaggtttggctgctcaccactcaaaagccaaatacgagagatgaggttggtgagaggaaaagcaggtttattgggaaagccagagaaattgagaagatgatgagctagccttctaaagtaccatctccaggccaggcatggtagctcacatctgtaatcccagcactttgggatgccaaggcaggcggatcacctaaggtcaggagtttgagaccagcctgacccacaatggccaaacaccatctctactaaaaaatacaaaaattagccaggtgtggtggcacatgcctgtagtcccagctactcaggaggctgagacaggagaatagcttgaacctaggaagcagaggttgcagtgagccgagattgtaccactgcactccagcctgggcaacagagaatccatctcaagaaataataattttgtaaaaattaagtaaaatctccaattttttaggctggttggagggtttttatgggaggggggtatggggggagacgaaggggttagtatcgaggagactgaggaccatagacatttgggcaccagtgagggttcaagaaggttgagaacttctttgtccttggtcaggtcataatgctccttcagtctttagtatttttaatagagggtttcaccatattggccagactggtctctaactcctgacctcaggtgatccgcccgcctcggcctcccaaagtgctgggattacaggcgtgagccaccgtgcccagccactcctatcagtctttaacaatatatagttagttgtttatatacttcccctttaatcccagagttagtttctaaaagtacatgattgttgtttgtgtatattatctcggtgccataaaattatcctagcctacgtgcaggaaagggtaaaaccctttaaacaaaaatggagttagttatgttcgttcttttgctatttcacaattgtacctcagcctcccaaagtgctgggattacaagagtggtgtctttggagttttgagatgcggaaataatgaaaggctttcaaaatgtccaataacattatgaagtctttagagggaaacacgtgtatctgtatcctgacttttgcactaatcaattatagtacctgttataaagggcttgtagacatttcttaatgagtctacagatacttggtaacgtggaaatcctcagataagtttacctatgagaacacagtagatgttattttcagaaaattaaatattgcctgccctgtgaagtgtgtataatgtggctcacacaccaagggcctctccatgggtaggtgtccggccatctgccagcaaggagacagggagttatccgggaacacgcagaaccagaaaagaggctgacatgtttggaactaaggcttctggtcttctgaatgtcacattacctctgcctggtgttgggcaagaataagcaaaccgcaactctggtagagagtcttacgagacagatgttaacacctgagagttttatttttatgacttggatttgcagcaaaacaatctccacttgatgtgggattggtttccttctgttcagtttatgttgttaatgactctaagaggtttgcaagaggatctatggagccagttccagattggtcctcctacttagaatacagtgggtatccccatctgatacagtcacttgtaagtatatttgtctatgtatatatgcacatatatgtttctgtgtgtgatgtaaatgtagttttgaaaccaaatagtgtcacacacttgtacagggtaactagaattgtatgagtggctataaggcaaacactgcatcacaattatctgtaccatggaacaagcccatgagctcatgcctttggatcctacttatttcagtcaatattcaccactgttggggggtagcaggaatgcttagttcatctcttttggtggcattgtaatgtctttgctcacaagggtagaggtcaggaggcacagaaaaaagaaaatgggtttgggggccaatgactgggataaaatcctaaacccattagctaatagctatgacattaggcaagtgacttaatctctctgtgactattcgtaaaatttacaaaattggaagagcaatactattccatactaatactattatgaacattaaacaaaatactttttgtaaagtttgtacctgagagcttgacagagagtaggcactcaaaaacttttagcttgcttcacattataaaaatagcccagaacaatgaaactttcccccagtaatacacacaggagaaggggttcatgcttacaagctgccatatgaatgtactcaagttgtctcttctaaaaatatgccttgtatggatccagtaaagtctgtcattctagaaatgtatcagaactagatcaatcagagttaacaaaggaaacaaagaagatgaagtagaaaagcaacaatctgtggaaatctactacttttaaagtttttttggtacttcaattatgcatgtgtgtttttgtgtgtctgaatgtgtataaaatccaatggaggcctgacacggtggctcacgcctgtaatcccagcactttgggagactgaggcgggtggatcatgaggtcaggatatcgagaccatcctggccaacatggtgaagcccccactctactaaaaatacaaaaagtagctgggcgtggtggtggtggtgcatacctgtagtcccagctacttgggagtctgaggcaggagactcgcttgaacccgggaggcggagattgcagtgagccgagatcgcgccactgcactccagcctgggcgacagagcaagactccctctcacaaaaagaaaaaaagaatccaacaatattttaaatattgttacatatagccaatattcattcagattcaccatgtatctaccattttcattcctcttcattcctccctgtacaaacttcaatctagatttgttttttctctacctaaagaataccttttagtattttctataatgcagatctgttgatggtgaattcttttaattactgtttgtctgaacatgtctctattttgccttcattctggaaggatctttttgctccatatagaattcgccattgacaattctttttctttagcactgtaaagatattccattgtctccattgtctactggcttccattatttttgttgagatgtaaactgtgagttccattgttgcttatttggagataatatgtattttgttctagaggctttttttttttaatggagtttctctattgtcgcccagtctagagtgtgatggaatgatcttggctcactgcaacgatcttggctcactgcaacgatcttggctcactgcaacctccgcctcccgggttcaagtgattctcctgcctcagccccccgagtagctgggattacaggttcctgccaccatgcccagctaatttttgcatttttagtagagatggggtttcaccatgttggccagactggtctcaaactcctgacctcaggtaatccacccacctcggcctcccaaagtgctgggattacaggcaggagccaccacacccagcctgttctagaggcttttaacgatattttttcctgtttagtttacaagatgtctttgatttatagcagtttaattctcatctgcctcagtgaggatttctttttgtttatttttcctgtttggggctaggccttcttgaaactgtcttattatccttcttcagtttgggaaaattcttagccattacctcctcaagtattaacttctgccctattatctccctctcttcctcctcctaggattcaaattatgtgtctgttagcccctctcaatgtatcctatgtgtctcttaccctctcctccatattgaccatctttttgtctctatgttcactctgtggagtctcttctaaagctctaattagagaatccagttcctgaattctttcttaatccatgtctattcaactggaaagctcattgcattcttgatttcagtggtgtatattttaattctacaattctcatagaccttttttaattaattaattattattattattattatttattttttttttttttagagacagagtctcactctgttgtccaggctggagtgcagtcttgtgatcatagctcactgcaacctctaactcctgggctcaagatcctcctgcctcagcctcctgagtagttgggactacaggcacgcatcaccacactaggctatttttttttaaatttctgtagaaacggggtctcattttgttgcccagactggtctgaaactcctggcctcaagtgatcctccctgtctcagcctcccaaagtactgagattacaggcatgagccaccatgcctggcttcatggatcttttaaaaacagattctagtttcctatcaaaattctcaagctgtctttaatcttcttaattattgtaagcatagtctttgtaaagtctatatgtatgactctatatgagaagccctggtgcatccttttttaagatctgatattttgctagtgcttatacaagctatctggtctcctcatgaccaccaccccccttttttaaattgaatgcttttatttgcaaaattgtgaaagtaattcaagaccttaatccagttttagggactcagatgagtcaatctgagcttcagaccttgaaaggcctgttggcttgtggttcactgtctcctctaagggacagtgctttggggtcacaactcaaaagaatggggctcaccagagaacaccctcccttggtgtatcctgaactccattacctgttccctatgctcttaacactatcaaaagcccacttggtttcccaactgctccactttggaatgttcaagtgccttcaggagaaaacaggcccccaacaccagcttcacctctctgggccatcatcttttcctgatccaacccaggaagtgtgtgtgtgtgtgtgtgtgtgtgtgtgtgtgtgtgtgtgtgtgtgacggagtttcactctgtcgcccaggctggagtgaagtggcatgatctcggttcactgcagcctccgcctcccgggttcaagcgattctcttgcctcagcctcctgagtagctgggattataggcgcctgccaccacacctggctaatttttgtatttttagtagggacagggtttcaccatgctggccaggctggtctcagagtaaagtggcacgatcttggctcactgcaaccttcgtcccccggactcaaacgattctcctgcctcagcctcctgagtagctgggattataggggcccaccaccacacctggctaagttttgtatttttagtagagatggggttttgccatggtagccaggctggtctcaaactcctgacctcaggtgatccacgcgccttggcctcccaaagtgctgggattacaggcatgagccaccgcgcctggcctttttactatcttatttgctgtccagtactataagaaaaaaagtttaaacattttgtccagagtttttaaatttatttgtttgcttatatttttgttcagagtttttagttgtcctcagaaggagggttggtccaaattacctagtctactacatctagaaaggacattggaaattgactttttttttttttttttgagacggagtctcactctgtggcccaggctggatcgcccagtggcacgatctcggctcgctgcaacatctgcctcctgggttcaagtgattctagtgtttcagcctcccaagtagctgggattacaggtgcccgccaccacgcatggctaattttttttttttatttttagtggagacggggtttccccatgttggccaggctggtcttgaactcctgacctcaaatgatccacccaccttggtgtcccaaagtgctgggattacaggcatgagccactgtgcccagccaccaagcatccttttaggggctggggactcagtgataaacacactgtgcctgcttcttggaactcacagtctcactctgatccatgtttagtcctgtcctgtatgataatagcagttgtccattgagctcataaaatctaagaccgcgctgggcttgtgagccacctgcagagcctagcttggtgctgaaagctaagtgggtgctctgtcattactggggttcgattgactggttctaacagagaccagctatagagctaacacttgatggaatattttgaatattgatgaccttttcactggcttctgcctatggcaagtagaggtacaacccaaagagaagagcctcatttatagtgtgtggctgggggagagggaggtttgcaaactgagtcattttcccccattcagcctgtgtgtgtctgtgtgagttcatacctgtgtgtgtgcataaaatcaaacaagaataaaatgttttcatttgttcccttccttcttcctctctctgtctctccctgtttccacaggtcagcgttgaagttttggtagagtatcctttttttgtgtttggacagggctggtcatcctgctgtccggagagaaccagccagctctttgatttgccgtgttccaaactctcagttggggatgtctgcatctcgcttaccctcaagaacctgaagaacggctctgttaaaaagggccagcccgtggatcccgccagcgtcctgctgaagcactcaaaggccgacggcctggcgggcagcagacacaggtatgccgagcaggaaaacggaatcaaccaggggagtgcccagatgctctctgagaatggcgaactgaagtttccagagaaaatgggattgcctgcagcgcccttcctcaccaaaatagaacccagcaagcccgcggcaacgaggaagaggaggtggtcggcgccagagagccgcaaactggagaagtcagaagacgaaccacctttgactcttcctaagccttctctaattcctcaggaggttaagatttgcattgaaggccggtctaatgtaggcaagtagaggcagcgtgggggaaaggaaacgtggctctcccttatcatttgtatccagattactgtactgtaggctaaaataacacagtatttacatgttatcttcttaattttaggtttctgttctaaccttgtcattagagttacagcaggtgtgtcgcaggagactggtgcatatgctttttccacgagtgtctgtcagtgagcgggcgggaggaagggcacagcaggagcggtcagggctccaggcatccccggggaagaaaggaacggggcttcacagtgcctgccttctctagcggcacagaagcagccgggggcgctgactcccgctagtgtcaggagaaaagtcccgtgggaagggtcctgcaggggtgcagggttgcacgcatgtgggggtgcacaggcgctgtggcggcgagtgagggtctctttttctctgcctccctctgcctcactctcttgctatcggcatgggccgggggggttcagagcagtgtcctcctggggttcccacgtgcaaaatcaacatcaggaacccagcttcagggcatcgcggagacgcgtcagatggcagatttggaaagttaaccatttaaaagaacatttttctctccaacatattttacaataaaagcaacttttaattgtatagatatatatttccccctatggggcctgactgcactgatatatattttttttaaagagcaactgccacatgcgggatttcatttctgctttttactagtgcagcgatgtcaccagggtgttgtggtggacagggaagcccctgctgtcatggccccacatggggtaaggggggttgggggtgggggagagggagagagcgaacacccacgctggtttctgtgcagtgttaggaaaaccaatcaggttattgcattgacttcactcccaagaggtagatgcaaactgcccttcagtgagagcaacagaagctcttcacgttgagtttgcgaaatctttttgtctttgaactctagtactgtttatagttcatgactatggacaactcgggtgccactttttttttttttcagattccagtgtgacatgaggaattagattttgaagatgagcatatattactatctttaagcatttaaaaatactgttcacactttattaccaagcatcttggtctctcattcaacaagtactgtatctcactttaaactctttggggaaaaaacaaaaacaaaaaaaactaagttgctttctttttttcaacactgtaactacatttcagctctgcagaattgctgaagagcaagatattgaaagtttcaatgtggtttaaagggatgaatgtgaattatgaactagtatgtgacaataaatgaccaccaagtactacctgacgggaggcacttttcactttgatgtctgagaatcagttcaaggcatatgcagagttggcagagaaactgagagaaaagggatggagaagagaatactcatttttgtccagtgtttttctttttaagatgaacttttaaagaaccttgcgatttgcacatattgagtttataacttgtgtgatattcctgcagtttttatccaataacattgtgggaaaggtttgggggactgaacgagcataaataaatgtagcaaaatttctttctaacctgcctaaactctaggccattttataaggttatgttcctttgaaaattcattttggtctttttaccacatctgtcacaaaaagccaggtcttagcgggctcttagaaactctgagaattttcttcagattcattgagagagttttccataaagacatttatatatgtgagcaagattttttttaaacaattactttattattgttgttattaatgttattttcagaatggcttttttttttctattcaaaatcaaatcgagatttaatgtttggtacaaacccagaaagggtatttcatagtttttaaacctttcattcccagagatccgaaatatcatttgtgggttttgaatgcatctttaaagtgctttaaaaaaaagttttataagtagggagaaatttttaaatattcttacttggatggctgcaactaaactgaacaaatacctgacttttcttttaccccattgaaaatagtactttcttcgtttcacaaattaaaaaaaaaatctggtatcaacccacattttggctgtctagtattcatttacatttagggttcaccaggactaatgatttttataaaccgttttctggggtgtaccaaaaacatttgaataggtttagaatagctagaatagttccttgactttcctcgaatttcattaccctctcagcatgcttgcagagagctgggtgggctcattcttgcagtcatactgcttatttagtgctgtattttttaaacgtttctgttcagagaacttgcttaatcttccatatattctgctcagggcacttgcaattattaggttttgtttttctttttgttttttagcctttgatggtaagaggaatacgggctgccacatagactttgttctcattaatatcactatttacaactcatgtggactcagaaaaacacacaccaccttttggcttacttcgagtattgaattgactggatccactaaaccaacactaagatgggaaaacacacatggtttggagcaataggaacatcatcataatttttgtggttctatttcaggtataggaattataaaataattggttctttctaaacacttgtcccatttcattctcttgcttttttagcatgtgcaatactttctgtgccaatagagtctgaccagtgtgctatatagttaaagctcattcccttttggctttttccttgtttggttgatcttccccattctggccagagcagggctggagggaaggagccaggagggagagagcctcccacctttcccctgctgcggatgctgagtgctggggcggggagccttcaggagccccgtgcgtctgccgccacgttgcagaaagagccagccaaggagacccgggggaggaaccgcagtgtcccctgtcaccacacggaatagtgaatgtggagtgtggagaggaaggaggcagattcatttctaagacgcactctggagccatgtagcctggagtcaacccattttccacggtcttttctgcaagtgggcaggcccctcctcggggtctgtgtccttgagacttggagccctgcctctgagcctggacgggaagtgtggcctgttgtgtgtgtgcgttctgagcgtgttggccagtggctgtggaggggaccacctgccacccacggtcaccactcccttgtggcagctttctcttcaaataggaagaacgcacagagggcaggagcctcctgtttgcagacgttggcgggccccgaggctcccagagcagcctctgtcaccgcttctgtgtagcaaacattaacgatgacaggggtagaaattcttcggtgccgttcagcttacaaggatcagccatgtgcctctgtactatgtccactttgcaatatttaccgacagccgtcttttgttctttctttcctgttttccatttttaaactagtaacagcaggccttttgcgtttacaatggaacacaatcaccaagaaattagtcagggcgaaaagaaaaaaataatactattaataagaaaccaacaaacaagaacctctctttctagggatttctaaatatataaaatgactgttccttagaatgtttaacttaagaattatttcagtttgtctgggccacactggggcagaggggggagggagggatacagagatggatgccacttacctcagatcttttaaagtggaaatccaaattgaattttcatttggactttcaggataattttctatgttggtcaacttttcgttttccctaactcacccagtttagtttgggatgatttgatttctgttgttgttgatcccatttctaacttggaattgtgagcctctatgttttctgttaggtgagtgtgttgggttttttccccccaccaggaagtggcagcatccctccttctcccctaaagggactctgcggaacctttcacacctctttctcagggacggggcaggtgtgtgtgtggtacactgacgtgtccagaagcagcactttgactgctctggagtagggttgtacaatttcaaggaatgtttggatttcctgcatcttgtggattactccttagataccgcatagattgcaatataatgctgcatgttcaagatgaacagtagctcctagtaatcataaaatccactctttgcacagtttgatctttactgaaatatgttgccaaaatttatttttgttgttgtagctctggattttgttttgttttgttttttaaggaaacgattgacaataccctttaacatctgtgactactaaggaaacctatttctttcatagagagaaaaatctccaatgcttttgaagacactaataccgtgctatttcagatatgggtgaggaagcagagctctcggtaccgaaggccgggcttcttgagctgtgttggttgtcatggctactgtttcatgaaccacaagcagctcaacagactggtctgttgccttctgaaaccctttgcacttcaatttgcaccaggtgaaaacagggccagcagactccatggcccaattcggtttcttcggtggtgatgtgaaaggagagaattacactttttttttttttaagtggcgtggaggcctttgcttccacatttgtttttaacccagaatttctgaaatagagaatttaagaacacatcaagtaataaatatacagagaatatacttttttataaagcacatgcatctgctattgtgttgggttggtttcctctcttttccacggacagtgttgtgtttctggcatagggaaactccaaacaacttgcacacctctactccggagctgagatttcttttacatagatgacctcgcttcaaatacgttaccttactgatgataggatcttttcttgtagcactataccttgtgggaatttttttttaaatgtacacctgatttgagaagctgaagaaaacaaaattttgaagcactcactttgaggagtacaggtaatgttttaaaaaattgcacaaaagaaaaatgaatgtcgaaatgattcattcagtgtttgaaagatatggctctgttgaaacaatgagtttcatactttgtttgtaaaaaaaaaaaagcagagaagggttgaaagttacatgtttttttgtatatagaaatttgtcatgtctaaatgatcagatttgtatggttatggcctggaagaattactacgtaaaaggctcttaaactatacctatgcttattgttatttttgttacatatagccctcgtctgagggaggggaactcggtattctgcgatttgagaatactgttcattcctatgctgaaagtacttctctgagctcccttcttagtctaaactcttaagccattgcaacttctttttcttcagagatgatgtttgacattttcagcacttcctgttcctataaacccaaagaatataatcttgaacacgaagtgtttgtaacaagggatccaggctaccaatcaaacaggactcattatggggacaaaaaaaaaaattatttcaccttctttccccccacacctcatttaaatggggggagtaaaaacatgatttcaatgtaaatgcctcattttattttagttttattttgatttttatttaatataaagaggccagaataaatacggagcatcttctcagaatagtattcctgtccaaaaatcaagccggacagtggaaactggacagctgtggggatattaagcacccccacttacaattcttaaattcagaatctcgtcccctcccttctcgttgaaggcaactgttctggtagctaactttctcctgtgtaatggcgggagggaacaccggcttcagtttttcatgtccccatgacttgcatacaaatggttcaactgtattaaaattaagtgcatttggccaataggtagtatctatacaataacaacaatctctaagaatttccataacttttcttatctgaaaggactcaagtcttccactgcagatacattggaggcttcacccacgttttctttccctttagtttgtttgctgtctggatggccaatgagcctgtctccttttctgtggccaatctgaaggccttcgttggaagtgttgtttacagtaatccttaccaagataacatactgtcctccagaataccaagtattaggtgacactagctcaagctgttgtcttcagagcagttaccaagaagctcggtgcacaggttttctctggttcttacaggaaccacctactctttcagttttctggcccaggagtggggtaaatcctttagttagtgcatttgaacttgatacctgtgcattcagttctgtgaatactgccctttttggcggggtttcctcatctccccagcctgaactgctcaactctaaacccaaattagtgtcagccgaaaggaggtttcaagatagtcctgtcagtatttgtggtgaccttcagattagacagtcttcatttccagccagtggagtcctggctccagagccatctctgagactcgtactactggatgttttaatatcagatcattacccaccatatgcctcccacaggccaagggaaaacagacaccagaacttgggttgagggcactaccagactgacatggccagtacagaggagaactagggaaggaatgatgttttgcaccttattgaaaagaaaattttaagtgcatacataatagttaagagcttttattgtgacaggagaacttttttccatatgcgtgcatactctctgtaattccagtgtaaaatattgtacttgcactagcttttttaaacaaatattaaaaaatggaagaattcatattctattttctaatcgtggtgtgtctatttgtaggatacactcgagtctgtttattgaattttatggtccctttctttgatggtgcttgcaggttttctaggtagaaattatttcattattataataaaacaatgtttgattcaaaatttgaacaaaattgttttaaataaattgtctgtataccagtacaagtttattgtttcagtatactcgtactaataaaataacagtgccaattgcagatgtgtgtctttgccttctgttgggtcctcaaggaagaggccaggaaaagagtgctaattcctcctccttattgacccccgctcacgagttctccctgggtaggtcggaggtagggaggtgtgacatgaggcattgccttcgctgctaatgttttggggggaagagtacgtgtgagatgaggttctaagataaaaggcacacagccacacctgatgtcttggtttcttcagttcatgtttatgcctcctagctgaacactgctgttcacaagaggtatacttgtctttaaacatgtggtagcttcatgcgctcgtgtggcataatctatacactccttacagatttgctctaaactggttagtggtctgtaagtggaaaatttatttttacttcctgtaattcaagctcattagaaattcagcgagcagaccgggcacagtggctcacgcccataatcccaacagttggggaggccgaggcacaaggcctgcttgagcccaggagttcgagaccagcctagtcaacatagtaagacctcatctctacaaaaaatgaaattagccgggtgtggtggcacatacctatggtcccagctacttaggggactgaggtgggaggatcgcctggggccaggaggtcgaggctgcagtgagccataatcataccgctgcactccagcctgggcgacagagcaaaactctgcctcaaaaacaaaaaaaaaacccaactcctcgagcaggtctctcagcatgtggaggaactccccgtttacctcaagagtaccacattacagctttgcactgggcccagtcttggaaagatatggcttagcagttgtgccagaaaaagtaattcctcaagaacccatagcttccaggtggaatcccctgcacccacctcaacccacctcaacccacctcaagaccttccagcctcaaggttacacagaggtgggagaacgcttggggttaaattcattttcacttagccaaggaggaactatcttcttgggaaggtgttttggactctcctctgattatttagttgaggtcctgacacattatataataaatatgtgaaaggacacacagcaaaccagagctgtgtaggtgcaactcaggctacaagggctgccccaggtcctgtggagtagcccgggcaaatgtgcctgtgtgctgtgggcaaactcggcaaagcagtctgcatctctgccttccctttttgtttgtgtgagatactgattgttctgacaagtttggggtccagtggctgtgttacttacctcagctggtgaaatcaattagggggaaccataccttcaggtgctgcagcggggcaggacttgaaaccatcaaaagcactgccagagccctcagatggaacggccagagtggcccaaggcaaatggcgtcgagttcactggctgtcctcctcctcccccagctctggcacaggaagcccagtgggtcagcagcaaagctgcatgcttcatctccaggtcctgtgggacacccggtccaagggacactctggtgtgggctcccccagccccactcctatcagaggcagagatgaacctgctaaggcaaacggtgacggagccttacaagttctctttatgggccaggcgcggtggctcacacctgtaatcccagcactttgggaggctgaggtgggtggatcacccgagcccaggagtttgagaccagcctgggtaacatggcaaaaacccatctctactaaaaacataaacattagccagacgtggcgggcacctgtaatcccggctactctgaaggctgaggcacgagaatcacttgaacctgggaggcggaggttgcagtgagccgagattgtgccactgcactctgcctgggtgacagagcaagacttggtctcaggaaaaaaaaaaaaaaaaaagacattctctttctgaaggctctgcttcaaaatggtcctaacgagtttttgattttgtaactactcagttacaagcagctggaagaccacagagagcaaggcggggagcctgcagccaagccccatgtcttgctccacgttaaatcgcctcttggccctcccgtctccaaagtgcagcccttgtgtttctacaggtgcaagagttattcttaatgggccgggcacagtggctcacacctgtaatcctagcactttggggaggttgacgcaggtggatggcttgagccctggagtttgagaccagtctgggcaacatggtgagaccctgtctctataaaaaatacaaaaattagctgggcgtggtagcaggtgtctgtagtcccagctacttgggagactgaggtcagaggatcacctgagcccgggaggtcaaggctgtggtgagctgtgatcctgccactgcactccagcctgggcaacagagaccctgtctcaaattaaaaaaaaaaaaaaaaaaaaaaaaaaaaaactcttaatggatttagtaggggaaagtattacaatggagacaatgctgctggctggatctctaaacataatcttaaaggaccaacagtgggcctgtattatcccagagtgtgacagctctggttggacccttctcatgccatcggtcactgtggacaatcaggccattcattcaccctggcacagcagcaccctgtggatcttctctactccagggtcattgcttgcctttccaaagaaaactgacttgtgtatctgctcttcagccttattaaaaagcaaagtaaaacaacctgatctgcatacgctttccaggcctggaactcaatacttcaaagtttagcggccggtcatcacttcttctgcgttcactgtttaaacaagcatcctggtggactgctgcaggtcagctgcagaggccaattctccaagacaatgtcattgttcccaacccgttaactgacccttatacagtagtgccatgtggtccttccgagaaaggattcactggcacactgagggaatggctctaactcatgtctcaaaccaatgccttttaggatgccactgatcaaagctttggctctttttcagtgtgactccacctgctaatttcttgggagacaaccttcccataaaacatcctgtggaatttcaaatt

SEQ ID NO: 3 - DNA, 10587 bp, Homo sapiens
gaggagagagcagagtataccgcagacatcatttctactacagtggcggagccgtacaggacctgtttcactgcagggggatccaaaacaagccccgtggagcagcagccagagcaacagcagccgcaagacattgtttctctccctctgcccccccttccccacgcaaccccagatccatttacactttacagagcatcgtgcatcaagtcaccagggtggtccattcaagctgcagatttgtttgtcatccttgtacagcaatctcctcctccactgccactacagggaagtgcatcacatgtcagcatactggagcatagtgaaagagtctattttgaagcttcaaacttagtgctgctgcagaccaggaacaagagagaaagagtggatttcagcctgcacggatggtcttgaaacacaaatggtttttggtctaggcgttttacactgagattctccactgccaccctttctactcaagcaaaatcttcgtgaaaagatctgctgcaaggaactgatagcttatggttctccattgtgatgaaagcacatggtacagttttccaaagaaattagaccattttcttcgtgagaaagaaatcgacgtgctgttttcatagggtatttctcacttctctgtgaaaggaagaaagaacacgcctgagcccaagagccctcaggagccctccagagcctgtgggaagtctccatggtgaagtataggctgaggctacctgtgaacagtacgcagtgaatgttcatccagagctgctgttggcggattgtacccacggggagatgattcctcatgaagagcctggatcccctacagaaatcaaatgtgactttccgtttatcagactaaaatcagagccatccagacagtgaaacagtcaccgtggaggggggacggcgaaaaatgaaatccaaccaagagcggagcaacgaatgcctgcctcccaagaagcgcgagatccccgccaccagccggtcctccgaggagaaggcccctaccctgcccagcgacaaccaccgggtggagggcacagcatggctcccgggcaaccctggtggccggggccacgggggcgggaggcatgggccggcagggacctcggtggagcttggtttacaacagggaataggtttacacaaagcattgtccacagggctggactactccccgcccagcgctcccaggtctgtccccgtggccaccacgctgcctgccgcgtacgccaccccgcagccagggaccccggtgtcccccgtgcagtacgctcacctgccgcacaccttccagttcattgggtcctcccaatacagtggaacctatgccagcttcatcccatcacagctgatccccccaaccgccaaccccgtcaccagtgcagtggcctcggccgcaggggccaccactccatcccagcgctcccagctggaggcctattccactctgctggccaacatgggcagtctgagccagacgccgggacacaaggctgagcagcagcagcagcagcagcagcagcagcagcagcagcatcagcatcagcagcagcagcagcagcagcagcagcagcagcagcagcagcacctcagcagggctccggggctcatcaccccggggtcccccccaccagcccagcagaaccagtacgtccacatttccagttctccgcagaacaccggccgcaccgcctctcctccggccatccccgtccacctccacccccaccagacgatgatcccacacacgctcaccctggggcccccctcccaggtcgtcatgcaatacgccgactccggcagccactttgtccctcgggaggccaccaagaaagctgagagcagccggctgcagcaggccatccaggccaaggaggtcctgaacggtgagatggagaagagccggcggtacggggccccgtcctcagccgacctgggcctgggcaaggcaggcggcaagtcggttcctcacccgtacgagtccaggcacgtggtggtccacccgagcccctcagactacagcagtcgtgatccttcgggggtccgggcctctgtgatggtcctgcccaacagcaacacgcccgcagctgacctggaggtgcaacaggccactcatcgtgaagcctccccttctaccctcaacgacaaaagtggcctgcatttagggaagcctggccaccggtcctacgcgctctcaccccacacggtcattcagaccacacacagtgcttcagagccactcccggtgggactgccagccacggccttctacgcagggactcaaccccctgtcatcggctacctgagcggccagcagcaagcaatcacctacgccggcagcctgccccagcacctggtgatccccggcacacagcccctgctcatcccggtcggcagcactgacatggaagcgtcgggggcagccccggccatagtcacgtcatccccccagtttgctgcagtgcctcacacgttcgtcaccaccgcccttcccaagagcgagaacttcaaccctgaggccctggtcacccaggccgcctacccagccatggtgcaggcccagatccacctgcctgtggtgcagtccgtggcctccccggcggcggctccccctacgctgcctccctacttcatgaaaggctccatcatccagttggccaacggggagctaaagaaggtggaagacttaaaaacagaagatttcatccagagtgcagagataagcaacgacctgaagatcgactccagcaccgtagagaggattgaagacagccatagcccgggcgtggccgtgatacagttcgccgtcggggagcaccgagcccaggtcagcgttgaagttttggtagagtatcctttttttgtgtttggacagggctggtcatcctgctgtccggagagaaccagccagctctttgatttgccgtgttccaaactctcagttggggatgtctgcatctcgcttaccctcaagaacctgaagaacggctctgttaaaaagggccagcccgtggatcccgccagcgtcctgctgaagcactcaaaggccgacggcctggcgggcagcagacacaggtatgccgagcaggaaaacggaatcaaccaggggagtgcccagatgctctctgagaatggcgaactgaagtttccagagaaaatgggattgcctgcagcgcccttcctcaccaaaatagaacccagcaagcccgcggcaacgaggaagaggaggtggtcggcgccagagagccgcaaactggagaagtcagaagacgaaccacctttgactcttcctaagccttctctaattcctcaggaggttaagatttgcattgaaggccggtctaatgtaggcaagtagaggcagcgtgggggaaaggaaacgtggctctcccttatcatttgtatccagattactgtactgtaggctaaaataacacagtatttacatgttatcttcttaattttaggtttctgttctaaccttgtcattagagttacagcaggtgtgtcgcaggagactggtgcatatgctttttccacgagtgtctgtcagtgagcgggcgggaggaagggcacagcaggagcggtcagggctccaggcatccccggggaagaaaggaacggggcttcacagtgcctgccttctctagcggcacagaagcagccgggggcgctgactcccgctagtgtcaggagaaaagtcccgtgggaagggtcctgcaggggtgcagggttgcacgcatgtgggggtgcacaggcgctgtggcggcgagtgagggtctctttttctctgcctccctctgcctcactctcttgctatcggcatgggccgggggggttcagagcagtgtcctcctggggttcccacgtgcaaaatcaacatcaggaacccagcttcagggcatcgcggagacgcgtcagatggcagatttggaaagttaaccatttaaaagaacatttttctctccaacatattttacaataaaagcaacttttaattgtatagatatatatttccccctatggggcctgactgcactgatatatattttttttaaagagcaactgccacatgcgggatttcatttctgctttttactagtgcagcgatgtcaccagggtgttgtggtggacagggaagcccctgctgtcatggccccacatggggtaaggggggttgggggtgggggagagggagagagcgaacacccacgctggtttctgtgcagtgttaggaaaaccaatcaggttattgcattgacttcactcccaagaggtagatgcaaactgcccttcagtgagagcaacagaagctcttcacgttgagtttgcgaaatctttttgtctttgaactctagtactgtttatagttcatgactatggacaactcgggtgccactttttttttttttcagattccagtgtgacatgaggaattagattttgaagatgagcatatattactatctttaagcatttaaaaatactgttcacactttattaccaagcatcttggtctctcattcaacaagtactgtatctcactttaaactctttggggaaaaaacaaaaacaaaaaaaactaagttgctttctttttttcaacactgtaactacatttcagctctgcagaattgctgaagagcaagatattgaaagtttcaatgtggtttaaagggatgaatgtgaattatgaactagtatgtgacaataaatgaccaccaagtactacctgacgggaggcacttttcactttgatgtctgagaatcagttcaaggcatatgcagagttggcagagaaactgagagaaaagggatggagaagagaatactcatttttgtccagtgtttttctttttaagatgaacttttaaagaaccttgcgatttgcacatattgagtttataacttgtgtgatattcctgcagtttttatccaataacattgtgggaaaggtttgggggactgaacgagcataaataaatgtagcaaaatttctttctaacctgcctaaactctaggccattttataaggttatgttcctttgaaaattcattttggtctttttaccacatctgtcacaaaaagccaggtcttagcgggctcttagaaactctgagaattttcttcagattcattgagagagttttccataaagacatttatatatgtgagcaagattttttttaaacaattactttattattgttgttattaatgttattttcagaatggcttttttttttctattcaaaatcaaatcgagatttaatgtttggtacaaacccagaaagggtatttcatagtttttaaacctttcattcccagagatccgaaatatcatttgtgggttttgaatgcatctttaaagtgctttaaaaaaaagttttataagtagggagaaatttttaaatattcttacttggatggctgcaactaaactgaacaaatacctgacttttcttttaccccattgaaaatagtactttcttcgtttcacaaattaaaaaaaaaatctggtatcaacccacattttggctgtctagtattcatttacatttagggttcaccaggactaatgatttttataaaccgttttctggggtgtaccaaaaacatttgaataggtttagaatagctagaatagttccttgactttcctcgaatttcattaccctctcagcatgcttgcagagagctgggtgggctcattcttgcagtcatactgcttatttagtgctgtattttttaaacgtttctgttcagagaacttgcttaatcttccatatattctgctcagggcacttgcaattattaggttttgtttttctttttgttttttagcctttgatggtaagaggaatacgggctgccacatagactttgttctcattaatatcactatttacaactcatgtggactcagaaaaacacacaccaccttttggcttacttcgagtattgaattgactggatccactaaaccaacactaagatgggaaaacacacatggtttggagcaataggaacatcatcataatttttgtggttctatttcaggtataggaattataaaataattggttctttctaaacacttgtcccatttcattctcttgcttttttagcatgtgcaatactttctgtgccaatagagtctgaccagtgtgctatatagttaaagctcattcccttttggctttttccttgtttggttgatcttccccattctggccagagcagggctggagggaaggagccaggagggagagagcctcccacctttcccctgctgcggatgctgagtgctggggcggggagccttcaggagccccgtgcgtctgccgccacgttgcagaaagagccagccaaggagacccgggggaggaaccgcagtgtcccctgtcaccacacggaatagtgaatgtggagtgtggagaggaaggaggcagattcatttctaagacgcactctggagccatgtagcctggagtcaacccattttccacggtcttttctgcaagtgggcaggcccctcctcggggtctgtgtccttgagacttggagccctgcctctgagcctggacgggaagtgtggcctgttgtgtgtgtgcgttctgagcgtgttggccagtggctgtggaggggaccacctgccacccacggtcaccactcccttgtggcagctttctcttcaaataggaagaacgcacagagggcaggagcctcctgtttgcagacgttggcgggccccgaggctcccagagcagcctctgtcaccgcttctgtgtagcaaacattaacgatgacaggggtagaaattcttcggtgccgttcagcttacaaggatcagccatgtgcctctgtactatgtccactttgcaatatttaccgacagccgtcttttgttctttctttcctgttttccatttttaaactagtaacagcaggccttttgcgtttacaatggaacacaatcaccaagaaattagtcagggcgaaaagaaaaaaataatactattaataagaaaccaacaaacaagaacctctctttctagggatttctaaatatataaaatgactgttccttagaatgtttaacttaagaattatttcagtttgtctgggccacactggggcagaggggggagggagggatacagagatggatgccacttacctcagatcttttaaagtggaaatccaaattgaattttcatttggactttcaggataattttctatgttggtcaacttttcgttttccctaactcacccagtttagtttgggatgatttgatttctgttgttgttgatcccatttctaacttggaattgtgagcctctatgttttctgttaggtgagtgtgttgggttttttccccccaccaggaagtggcagcatccctccttctcccctaaagggactctgcggaacctttcacacctctttctcagggacggggcaggtgtgtgtgtggtacactgacgtgtccagaagcagcactttgactgctctggagtagggttgtacaatttcaaggaatgtttggatttcctgcatcttgtggattactccttagataccgcatagattgcaatataatgctgcatgttcaagatgaacagtagctcctagtaatcataaaatccactctttgcacagtttgatctttactgaaatatgttgccaaaatttatttttgttgttgtagctctggattttgttttgttttgttttttaaggaaacgattgacaataccctttaacatctgtgactactaaggaaacctatttctttcatagagagaaaaatctccaatgcttttgaagacactaataccgtgctatttcagatatgggtgaggaagcagagctctcggtaccgaaggccgggcttcttgagctgtgttggttgtcatggctactgtttcatgaaccacaagcagctcaacagactggtctgttgccttctgaaaccctttgcacttcaatttgcaccaggtgaaaacagggccagcagactccatggcccaattcggtttcttcggtggtgatgtgaaaggagagaattacactttttttttttttaagtggcgtggaggcctttgcttccacatttgtttttaacccagaatttctgaaatagagaatttaagaacacatcaagtaataaatatacagagaatatacttttttataaagcacatgcatctgctattgtgttgggttggtttcctctcttttccacggacagtgttgtgtttctggcatagggaaactccaaacaacttgcacacctctactccggagctgagatttcttttacatagatgacctcgcttcaaatacgttaccttactgatgataggatcttttcttgtagcactataccttgtgggaatttttttttaaatgtacacctgatttgagaagctgaagaaaacaaaattttgaagcactcactttgaggagtacaggtaatgttttaaaaaattgcacaaaagaaaaatgaatgtcgaaatgattcattcagtgtttgaaagatatggctctgttgaaacaatgagtttcatactttgtttgtaaaaaaaaaaaagcagagaagggttgaaagttacatgtttttttgtatatagaaatttgtcatgtctaaatgatcagatttgtatggttatggcctggaagaattactacgtaaaaggctcttaaactatacctatgcttattgttatttttgttacatatagccctcgtctgagggaggggaactcggtattctgcgatttgagaatactgttcattcctatgctgaaagtacttctctgagctcccttcttagtctaaactcttaagccattgcaacttctttttcttcagagatgatgtttgacattttcagcacttcctgttcctataaacccaaagaatataatcttgaacacgaagtgtttgtaacaagggatccaggctaccaatcaaacaggactcattatggggacaaaaaaaaaaattatttcaccttctttccccccacacctcatttaaatggggggagtaaaaacatgatttcaatgtaaatgcctcattttattttagttttattttgatttttatttaatataaagaggccagaataaatacggagcatcttctcagaatagtattcctgtccaaaaatcaagccggacagtggaaactggacagctgtggggatattaagcacccccacttacaattcttaaattcagaatctcgtcccctcccttctcgttgaaggcaactgttctggtagctaactttctcctgtgtaatggcgggagggaacaccggcttcagtttttcatgtccccatgacttgcatacaaatggttcaactgtattaaaattaagtgcatttggccaataggtagtatctatacaataacaacaatctctaagaatttccataacttttcttatctgaaaggactcaagtcttccactgcagatacattggaggcttcacccacgttttctttccctttagtttgtttgctgtctggatggccaatgagcctgtctccttttctgtggccaatctgaaggccttcgttggaagtgttgtttacagtaatccttaccaagataacatactgtcctccagaataccaagtattaggtgacactagctcaagctgttgtcttcagagcagttaccaagaagctcggtgcacaggttttctctggttcttacaggaaccacctactctttcagttttctggcccaggagtggggtaaatcctttagttagtgcatttgaacttgatacctgtgcattcagttctgtgaatactgccctttttggcggggtttcctcatctccccagcctgaactgctcaactctaaacccaaattagtgtcagccgaaaggaggtttcaagatagtcctgtcagtatttgtggtgaccttcagattagacagtcttcatttccagccagtggagtcctggctccagagccatctctgagactcgtactactggatgttttaatatcagatcattacccaccatatgcctcccacaggccaagggaaaacagacaccagaacttgggttgagggcactaccagactgacatggccagtacagaggagaactagggaaggaatgatgttttgcaccttattgaaaagaaaattttaagtgcatacataatagttaagagcttttattgtgacaggagaacttttttccatatgcgtgcatactctctgtaattccagtgtaaaatattgtacttgcactagcttttttaaacaaatattaaaaaatggaagaattcatattctattttctaatcgtggtgtgtctatttgtaggatacactcgagtctgtttattgaattttatggtccctttctttgatggtgcttgcaggttttctaggtagaaattatttcattattataataaaacaatgtttgattcaaaatttgaacaaaattgttttaaataaattgtctgtataccagtacaagtttattgtttcagtatactcgtactaataaaataacagtgccaattgca

SEQ ID NO: 4 - DNA, 1676 bp, Homo sapiens
ggggaggagagagcagagtataccgcagacatcatttctactacagtggcggagccgtacaggacctgtttcactgcagggggatccaaaacaagccccgtggagcagcagccagagcaacagcagccgcaagacattgtttctctccttctgcccccccttccccacgcaaccccagatccatttacactttacagtcacagaacagaaagtgctggtggacatctcttcttgccccaagatcttcgttggaagtccccgggacttggtgtctttgccgttcaaagtgtttatgaactcgccaggaggcataatgtgtcaccattttattctgggccaccctaaaggatgacacccagcttcagagacctcctcttggacgacatccctgagaatcaatgttttagctgtcccatagtctgacgtctgtttccgaccgcttttgagctggcgcaggcttagtcattaatggccaggacgatgttaaatgttctgcctgattggcttgcagctacacaccttttgtcatttgcagagcagcaactccctcttgagctcttggggagtctttacacaaatacactagaaaaaaggcacccatccattttttttccatcttggcattagctcacaggcatagtcctgggatgacctggagtagaggcagtggaggataaattcatcttgcacagacttgtttgtgctagttctagcctgtctctcgccacagatctagcttttaaatactcaagtgattggttttgtgtaggaatgtgtggattgttggattggaagaattttctccctggatttctagtgtttacataagcagatacaaaaaaaatttgatcactgatttaaatagcagggcttattttaaaaagttatgggtgcttcaaggtggtacagaataaaaatgtcagggtttttttttttttttttttttaacaagtcgtaacacaaccaaaatgtatatattaatgttttgtcaggaaagggtcaaaatggaaaatttgcaacaaagacaaactacaatagaacaagtgcaaacagaagctgacaaatatatgcccctcgttgggagttcagcccatggaatgttatgtaggacaaaaggaatggaagagatatttcagtaacattttgttctctgtcaaaaaccttctgaaatataaatctgctgtgtattggagaatggatacagcaattgattcaagttgaatagctttcatttaactagaatatcccacagaaagcagttcttgttctgacaaccatatttttgctttctttcacttaaagaaaattgaattcatgtttacatatcttatagggttgttttatggacaaagacacgggtcaaaccccatcacagtggctagtgttacaacaaatagaaacatttctaaatgaaataacatttctaagccagggccagtgcctgcagtaataatactaggttggtattatgaagccatttgcaactataaataattcagtcatagatgtgctttttttaaaatcctggttttttaaaattctagtcttttgccaatacacacacccatacacatacttcacctatttgcataatagaggaggaatatgaatatgtatataataaagtcactttattttggacttgcaaaaaaaaaaaaaaaaaaaaaaaaaaaaaa

SEQ ID NO: 5 - DNA, 924 bp, Homo sapiens
gaggaggagggatcacttgagttgagctctgctgactagattgcatttctgtgggaagagatggatggagcatgaggaaggccatgtgtgtgtctgggacataacaagccaatgcacgcatactggagcatagtgaaagagtctattttgaagcttcaaacttagtgctgctgcagaccaggaacaagagagaaagagtggatttcagcctgcacggatggtcttgaaacacaaatggtttttggtctaggcgttttacactgagattctccactgccaccctttctactcaagcaaaatcttcgtgaaaagatctgctgcaaggaactgatagcttatggttctccattgtgatgaaagcacatggtacagttttccaaagaaattagaccattttcttcgtgagaaagaaatcgacgtgctgttttcatagggtatttctcacttctctgtgaaaggaagaaagaacacgcctgagcccaagagccctcaggagccctccagagcctgtgggaagtctccatggtgaagtataggctgaggctacctgtgaacagtacgcagtgaatgttatctgatgcacaaaggaaaataataatacaaaacccataacctattcattgtattgttgcggtagatcgagctacatgctgcacagcaaaagaccttctttgcacttctttcaagcagaattattgctgtatattcactctgaactgagagatcattgcaaaaaaaaaaaagaagaagaagaagagaagaaaagaaaaaagaaataggttaagcaaattttgtggtggtgcttatgtgtgcacagacatgcatgaggcctccgcatcttccaaacttggaaagcatattttaacagcacaaatatatctacatgtttgatccaaaaaaaaaaaaaaaaaaaaaaaaaaaaaa

SEQ ID NO: 6 - DNA, 3375 bp, Homo sapiens
gtataccgcagacatcatttctactacagtggcggagccgtacaggacctgtttcactgcagggggatccaaaacaagccccgtggagcagcagccagagcaacagcagccgcaagacattgtttctctccctctgcccccccttccccacgcaaccccagatccatttacactttacagagcatcgtgcatcaagtcaccagggtggtccattcaagctgcagatttgtttgtcatccttgtacagcaatctcctcctccactgccactacagggaagtgcatcacatgtcaggtcacagaacagaaagtgctggtggacatctcttcttgccccaagatcttcgttggaagtccccgggacttggtgtctttgccgttcaaagtgtttatgaactcgccaggaggcataatgtgtcaccattttattctgggccaccctaaaggatgacacccagcttcagagacctcctcttggacgacatccctgagaatcaatgttttagctgtcccatagtctgacgtctgtttccgaccgcttttgagctggcgcaggcttagtcattaatggccaggacgatgttaaatgttctgcctgattggcttgcagctacacaccttttgtcatttgcagagcagcaactccctcttgagctcttggggagtctttacacaaatacactagaaaaaaggcacccatccattttttttccatcttggcattagctcacaggcatagtcctgggatgacctggagtagaggcagtggaggataaattcatcttgcacagacttgtttgtgctagttctagcctgtctctcgccacagatctagcttttaaatactcaagtgattggttttgtgtaggaatgtgtggattgttggattggaagaattttctccctggatttctagtgtttacataagcagatacaaaaaaaatttgatcactgatttaaatagcagggcttattttaaaaagttatgggtgcttcaaggtggtacagaataaaaatgtcagggttttgttttttttttttttttaacaagtcgtaacacaaccaaaatgtatatattaatgttttgtcaggaaagggtcaaaatggaaaatttgcaacaaagacaaactacaatagaacaagtgcaaacagaagctgacaaatatatgcccctcgttgggagttcagcccatggaatgttatgtaggacaaaaggaatggaagagatatttcagtaacattttgttctctgtcaaaaaccttctgaaatataaatctgctgtgtattggagaatggatacagcaattgattcaagttgaatagctttcatttaactagaatatcccacagaaagcagttcttgttctgacaaccatatttttgctttctttcacttaaagaaaattgaattcatgtttacatatcttatagggttgttttatggacaaagacacgggtcaaaccccatcacagtggctagtgttacaacaaatagaaacatttctaaatgaaataacatttctaagccagggccagtgcctgcagtaataatactaggttggtattatgaagccatttgcaactataaataattcagtcatagatgtgctttttttaaaatcctggttttttaaaattctagtcttttgccaatacacacacccatacacatacttcacctatttgcataatagaggaggaatatgaatatgtatataataaagtcactttattttggactttctgaaacagattaccttttttcttctcctcatgatggctccctgagttgcttccaattgttgaaattccataattacccacaaatatggatgtgcccttctaagggtcttgccatgtcaaccagcccagctgaaagctaatagccagtgttagcggtttaaggaactgagcttcagaattgagagcccccagcaaaggaagttctgtttttattctccatttctactctcctcaaggagaaattaggtgtttattgttttgttttgttttttaaattcccagatcattctggcattggtcctggattcgctgcaaatgtaatttttagcaacatctattactcctgaaatattttggctcttcgtggcctgtatgattcagtagactctgaggttttccaagtacattaaggacttaaatacagaatgtcttaaaattttagggctattgatcaagagaaagcttctcgaggaataaagttctgttaggttttagccctattctgctttcaaaattcttaactggatgccgtctattttgttttctttctgtgtttataactaatttgctacttgggtttattgttttcttacttagaaactacttttttttttgttttgtaaatgcacagcacttaaaaatataaaacagttccaaacagttccaacctgttcattgtttataccttgaccatcttttctgtcttattgctgaaccatcgcttctctttctacttctcttctgggatttcatcttgctcagctaaaattctagtgtgttattctgaatattatggctggagtttcctgaccaacttcttgcatctgagtccatttcctgtgcttaaggctgctggcattccattcactgctcctagtcaaaactgaaacttctcctgctaatgagattaggccttacaacactattaatttcttcctctctatttcttgctccattgttatttctcagagatgaaaatctatttgtcattatgagattcattttggcatcacttactaaagttcccttggatttttctgttcttcatacaccctacagcttcaaactgcaacagtcatcaactggtctttgacaaattagttgtctctacacatggtttacaatattacactagctgtttaaaaataattaagcttctttctgtgttctttgctgtgggtcaggaactttacttcctttgccatgcaacacagaagttaatcacaaatgggtcctctgaaccaaataattaaaaatagagcaaagtttctgaaccaggcggttggcagaaacgtctgtacttccatctgtgcatggttaggaaaatatttcacgatatttaaatagcatcagctttgctctcttttgtgtgagagtgtgtctgtgtgtctatgcgtaattcattgctttgaaggtttgtttgactgttagataatcatataaaaaaagttactggcaaggaaacaggaaagcaaatccaggtgttttgtgcatacattctttatttaccagtctctgtgaaggagcaatgatcttgcttttgcttttctctctgactgaaagtttttgccttgttatgtgctgcagaaaactaaataacattgcattttgactttgaaaaaaaaaaaaaaa

SEQ ID NO: 7-10 - skipped (4 entries)

SEQ ID NO: 11 - DNA, 22 bp, Artificial sequence
  Primer
catccagagtgcagagataagc

SEQ ID NO: 12 - DNA, 22 bp, Artificial sequence
  Primer
actctaccaaaacttcaacgct

SEQ ID NO: 13 - DNA, 25 bp, Artificial sequence
  Probe
agaggattgaagacagccatagccc

SEQ ID NO: 14 - DNA, 21 bp, Artificial sequence
  Primer
gtataggctgaggctacctgt

SEQ ID NO: 15 - DNA, 20 bp, Artificial sequence
  Primer
gatccaggctcttcatgagg

SEQ ID NO: 16 - DNA, 26 bp, Artificial sequence
  Probe
acagcagctctggatgaacattcact

SEQ ID NO: 17 - DNA, 15 bp, Artificial sequence
  Primer
tcgccgcttgctgca

SEQ ID NO: 18 - DNA, 17 bp, Artificial sequence
  Primer
atcggccgtgatgtcga

SEQ ID NO: 19 - DNA, 23 bp, Artificial sequence
  Probe
ccatggtcaaccccaccgtgttc

SEQ ID NO: 20-22 - skipped (3 entries)

SEQ ID NO: 23 - DNA, 20 bp, Artificial sequence
  Synthetic oligonucleotide
ctgcggtatactctgctctc

SEQ ID NO: 24 - DNA, 20 bp, Artificial sequence
  Synthetic oligonucleotide
ggaggaggagattgctgtac

SEQ ID NO: 25 - DNA, 20 bp, Artificial sequence
  Synthetic oligonucleotide
gtgcaggctgaaatccactc

SEQ ID NO: 26 - DNA, 20 bp, Artificial sequence
  Synthetic oligonucleotide
gtgttctttcttcctttcac

SEQ ID NO: 27 - DNA, 20 bp, Artificial sequence
  Synthetic oligonucleotide
atttcatttttcgccgtccc

SEQ ID NO: 28 - DNA, 20 bp, Artificial sequence
  Synthetic oligonucleotide
ctttgtgtaaacctattccc

SEQ ID NO: 29 - DNA, 20 bp, Artificial sequence
  Synthetic oligonucleotide
tcagctttcttggtggcctc

SEQ ID NO: 30 - DNA, 20 bp, Artificial sequence
  Synthetic oligonucleotide
gtgtggtctgaatgaccgtg

SEQ ID NO: 31 - DNA, 20 bp, Artificial sequence
  Synthetic oligonucleotide
gtcttccaccttctttagct

SEQ ID NO: 32 - DNA, 20 bp, Artificial sequence
  Synthetic oligonucleotide
ggctgtcttcaatcctctct

SEQ ID NO: 33 - DNA, 20 bp, Artificial sequence
  Synthetic oligonucleotide
tccgttttcctgctcggcat

SEQ ID NO: 34 - DNA, 20 bp, Artificial sequence
  Synthetic oligonucleotide
acttgcctacattagaccgg

SEQ ID NO: 35 - DNA, 20 bp, Artificial sequence
  Synthetic oligonucleotide
accgctcctgctgtgccctt

SEQ ID NO: 36 - DNA, 20 bp, Artificial sequence
  Synthetic oligonucleotide
cgctctctccctctccccca

SEQ ID NO: 37 - DNA, 20 bp, Artificial sequence
  Synthetic oligonucleotide
tgtttttgttttttccccaa

SEQ ID NO: 38 - DNA, 20 bp, Artificial sequence
  Synthetic oligonucleotide
attgaaactttcaatatctt

SEQ ID NO: 39 - DNA, 20 bp, Artificial sequence
  Synthetic oligonucleotide
cccttttctctcagtttctc

SEQ ID NO: 40 - DNA, 20 bp, Artificial sequence
  Synthetic oligonucleotide
ttttttttaaagcactttaa

SEQ ID NO: 41 - DNA, 20 bp, Artificial sequence
  Synthetic oligonucleotide
gattttttttttaatttgtg

SEQ ID NO: 42 - DNA, 20 bp, Artificial sequence
  Synthetic oligonucleotide
tgtgtgtttttctgagtcca

SEQ ID NO: 43 - DNA, 20 bp, Artificial sequence
  Synthetic oligonucleotide
gtgttttcccatcttagtgt

SEQ ID NO: 44 - DNA, 20 bp, Artificial sequence
  Synthetic oligonucleotide
tgggaggctctctccctcct

SEQ ID NO: 45 - DNA, 20 bp, Artificial sequence
  Synthetic oligonucleotide
cggtaaatattgcaaagtgg

SEQ ID NO: 46 - DNA, 20 bp, Artificial sequence
  Synthetic oligonucleotide
gtttgttggtttcttattaa

SEQ ID NO: 47 - DNA, 20 bp, Artificial sequence
  Synthetic oligonucleotide
ggcatccatctctgtatccc

SEQ ID NO: 48 - DNA, 20 bp, Artificial sequence
  Synthetic oligonucleotide
cattggagatttttctctct

SEQ ID NO: 49 - DNA, 20 bp, Artificial sequence
  Synthetic oligonucleotide
tctctatttcagaaattctg

SEQ ID NO: 50 - DNA, 20 bp, Artificial sequence
  Synthetic oligonucleotide
atctatgtaaaagaaatctc

SEQ ID NO: 51 - DNA, 20 bp, Artificial sequence
  Synthetic oligonucleotide
aattttttaaaacattacct

SEQ ID NO: 52 - DNA, 20 bp, Artificial sequence
  Synthetic oligonucleotide
ggtatagtttaagagccttt

SEQ ID NO: 53 - DNA, 20 bp, Artificial sequence
  Synthetic oligonucleotide
gcctctttatattaaataaa

SEQ ID NO: 54 - DNA, 20 bp, Artificial sequence
  Synthetic oligonucleotide
tctgaatttaagaattgtaa

SEQ ID NO: 55 - DNA, 20 bp, Artificial sequence
  Synthetic oligonucleotide
acctaatacttggtattctg

SEQ ID NO: 56 - DNA, 20 bp, Artificial sequence
  Synthetic oligonucleotide
gtgtctgttttcccttggcc

SEQ ID NO: 57 - DNA, 20 bp, Artificial sequence
  Synthetic oligonucleotide
gtatgcacttaaaattttct

SEQ ID NO: 58 - DNA, 20 bp, Artificial sequence
  Synthetic oligonucleotide
atagaatatgaattcttcca

SEQ ID NO: 59 - DNA, 20 bp, Artificial sequence
  Synthetic oligonucleotide
attggcactgttattttatt

SEQ ID NO: 60 - DNA, 20 bp, Artificial sequence
  Synthetic oligonucleotide
ggctctttaaatattactcc

SEQ ID NO: 61 - DNA, 20 bp, Artificial sequence
  Synthetic oligonucleotide
gtttgactagatgtgcttct

SEQ ID NO: 62 - DNA, 20 bp, Artificial sequence
  Synthetic oligonucleotide
tcttgagcttttaattttac

SEQ ID NO: 63 - DNA, 20 bp, Artificial sequence
  Synthetic oligonucleotide
tgctccttttatcattgtca

SEQ ID NO: 64 - DNA, 20 bp, Artificial sequence
  Synthetic oligonucleotide
cggtggtttgttgtaccctt

SEQ ID NO: 65 - DNA, 20 bp, Artificial sequence
  Synthetic oligonucleotide
tgtactctataattttttaa

SEQ ID NO: 66 - DNA, 20 bp, Artificial sequence
  Synthetic oligonucleotide
tgagctgcttttcatattct

SEQ ID NO: 67 - DNA, 20 bp, Artificial sequence
  Synthetic oligonucleotide
caatagacaaaaattatcat

SEQ ID NO: 68 - DNA, 20 bp, Artificial sequence
  Synthetic oligonucleotide
tttccgaagctgctatatgt

SEQ ID NO: 69 - DNA, 20 bp, Artificial sequence
  Synthetic oligonucleotide
gtctctctttttctaagtca

SEQ ID NO: 70 - DNA, 20 bp, Artificial sequence
  Synthetic oligonucleotide
agactaatatatatatatat

SEQ ID NO: 71 - DNA, 20 bp, Artificial sequence
  Synthetic oligonucleotide
gggtctcttcatctaccttc

SEQ ID NO: 72 - DNA, 20 bp, Artificial sequence
  Synthetic oligonucleotide
tgttcctttcttctttgttc

SEQ ID NO: 73 - DNA, 20 bp, Artificial sequence
  Synthetic oligonucleotide
gggtgtgtattcaattctct

SEQ ID NO: 74 - DNA, 20 bp, Artificial sequence
  Synthetic oligonucleotide
gtgactttaaagctttcctg

SEQ ID NO: 75 - DNA, 20 bp, Artificial sequence
  Synthetic oligonucleotide
actgagaggcatctccagtg

SEQ ID NO: 76 - DNA, 20 bp, Artificial sequence
  Synthetic oligonucleotide
tgtcaactagttcttatcac

SEQ ID NO: 77 - DNA, 20 bp, Artificial sequence
  Synthetic oligonucleotide
ggtaagggccactaaatctg

SEQ ID NO: 78 - DNA, 20 bp, Artificial sequence
  Synthetic oligonucleotide
cttaccacagagacatgccc

SEQ ID NO: 79 - DNA, 20 bp, Artificial sequence
  Synthetic oligonucleotide
ggagtattataacaatttgc

SEQ ID NO: 80 - DNA, 20 bp, Artificial sequence
  Synthetic oligonucleotide
gtctgggctgatgatgctgg

SEQ ID NO: 81 - DNA, 20 bp, Artificial sequence
  Synthetic oligonucleotide
gtctgcctttaacatttttc

SEQ ID NO: 82 - DNA, 20 bp, Artificial sequence
  Synthetic oligonucleotide
tgttgtttataagtttacgg

SEQ ID NO: 83 - DNA, 20 bp, Artificial sequence
  Synthetic oligonucleotide
tgcagcttattttataggtg

SEQ ID NO: 84 - DNA, 20 bp, Artificial sequence
  Synthetic oligonucleotide
cggtgtcttaatatcctcag

SEQ ID NO: 85 - DNA, 20 bp, Artificial sequence
  Synthetic oligonucleotide
gttcctcatcttaatcacag

SEQ ID NO: 86 - DNA, 20 bp, Artificial sequence
  Synthetic oligonucleotide
gtgactcatcttggctacag

SEQ ID NO: 87 - DNA, 20 bp, Artificial sequence
  Synthetic oligonucleotide
attttccatgtgtcacctgg

SEQ ID NO: 88 - DNA, 20 bp, Artificial sequence
  Synthetic oligonucleotide
gtgcagtgtcagcagtgcct

SEQ ID NO: 89 - DNA, 20 bp, Artificial sequence
  Synthetic oligonucleotide
gttgtcttactgatctggag

SEQ ID NO: 90 - DNA, 20 bp, Artificial sequence
  Synthetic oligonucleotide
tgagacctctctctacttgc

SEQ ID NO: 91 - DNA, 20 bp, Artificial sequence
  Synthetic oligonucleotide
tcagtccttggtggaagtgt

SEQ ID NO: 92 - DNA, 20 bp, Artificial sequence
  Synthetic oligonucleotide
tctgttgtttaaatatgtct

SEQ ID NO: 93 - DNA, 20 bp, Artificial sequence
  Synthetic oligonucleotide
tctttcatctctggatgccc

SEQ ID NO: 94 - DNA, 20 bp, Artificial sequence
  Synthetic oligonucleotide
gtgttctatctccagagtct

SEQ ID NO: 95 - DNA, 20 bp, Artificial sequence
  Synthetic oligonucleotide
tggtgaagataatgatgatc

SEQ ID NO: 96 - DNA, 20 bp, Artificial sequence
  Synthetic oligonucleotide
tccagttttaataaaagttc

SEQ ID NO: 97 - DNA, 20 bp, Artificial sequence
  Synthetic oligonucleotide
attttacttaatttttacaa

SEQ ID NO: 98 - DNA, 20 bp, Artificial sequence
  Synthetic oligonucleotide
atgtgcatatatacatagac

SEQ ID NO: 99 - DNA, 20 bp, Artificial sequence
  Synthetic oligonucleotide
cttttctacttcatcttctt

SEQ ID NO: 100 - DNA, 20 bp, Artificial sequence
  Synthetic oligonucleotide
gtgttctctggtgagcccca

SEQ ID NO: 101 - DNA, 20 bp, Artificial sequence
  Synthetic oligonucleotide
tgtagtagaaatgatgtctg

SEQ ID NO: 102 - DNA, 20 bp, Artificial sequence
  Synthetic oligonucleotide
aaatagactctttcactatg

SEQ ID NO: 103 - DNA, 20 bp, Artificial sequence
  Synthetic oligonucleotide
gtggcagtggagaatctcag

SEQ ID NO: 104 - DNA, 20 bp, Artificial sequence
  Synthetic oligonucleotide
tcagcctatacttcaccatg

SEQ ID NO: 105 - DNA, 20 bp, Artificial sequence
  Synthetic oligonucleotide
ggttggatttcatttttcgc

SEQ ID NO: 106 - DNA, 20 bp, Artificial sequence
  Synthetic oligonucleotide
tccactgtattgggaggacc

SEQ ID NO: 107 - DNA, 20 bp, Artificial sequence
  Synthetic oligonucleotide
ctcagctttcttggtggcct

SEQ ID NO: 108 - DNA, 20 bp, Artificial sequence
  Synthetic oligonucleotide
cgcttccatgtcagtgctgc

SEQ ID NO: 109 - DNA, 20 bp, Artificial sequence
  Synthetic oligonucleotide
tctgtttttaagtcttccac

SEQ ID NO: 110 - DNA, 20 bp, Artificial sequence
  Synthetic oligonucleotide
ggcgaactgtatcacggcca

SEQ ID NO: 111 - DNA, 20 bp, Artificial sequence
  Synthetic oligonucleotide
tggttgattccgttttcctg

SEQ ID NO: 112 - DNA, 20 bp, Artificial sequence
  Synthetic oligonucleotide
cctacagtacagtaatctgg

SEQ ID NO: 113 - DNA, 20 bp, Artificial sequence
  Synthetic oligonucleotide
cacgggacttttctcctgac

SEQ ID NO: 114 - DNA, 20 bp, Artificial sequence
  Synthetic oligonucleotide
gttcgctctctccctctccc

SEQ ID NO: 115 - DNA, 20 bp, Artificial sequence
  Synthetic oligonucleotide
ttgtttttgttttttcccca

SEQ ID NO: 116 - DNA, 20 bp, Artificial sequence
  Synthetic oligonucleotide
catttattgtcacatactag

SEQ ID NO: 117 - DNA, 20 bp, Artificial sequence
  Synthetic oligonucleotide
ggttctttaaaagttcatct

SEQ ID NO: 118 - DNA, 20 bp, Artificial sequence
  Synthetic oligonucleotide
cttttttttaaagcacttta

SEQ ID NO: 119 - DNA, 20 bp, Artificial sequence
  Synthetic oligonucleotide
ggttgataccagattttttt

SEQ ID NO: 120 - DNA, 20 bp, Artificial sequence
  Synthetic oligonucleotide
gtgtgtgtttttctgagtcc

SEQ ID NO: 121 - DNA, 20 bp, Artificial sequence
  Synthetic oligonucleotide
atgtgtgttttcccatctta

SEQ ID NO: 122 - DNA, 20 bp, Artificial sequence
  Synthetic oligonucleotide
gtctccttggctggctcttt

SEQ ID NO: 123 - DNA, 20 bp, Artificial sequence
  Synthetic oligonucleotide
gtgttccattgtaaacgcaa

SEQ ID NO: 124 - DNA, 20 bp, Artificial sequence
  Synthetic oligonucleotide
tcttgtttgttggtttctta

SEQ ID NO: 125 - DNA, 20 bp, Artificial sequence
  Synthetic oligonucleotide
tccactttaaaagatctgag

SEQ ID NO: 126 - DNA, 20 bp, Artificial sequence
  Synthetic oligonucleotide
gcacggtattagtgtcttca

SEQ ID NO: 127 - DNA, 20 bp, Artificial sequence
  Synthetic oligonucleotide
tcttaaattctctatttcag

SEQ ID NO: 128 - DNA, 20 bp, Artificial sequence
  Synthetic oligonucleotide
tcttcagcttctcaaatcag

SEQ ID NO: 129 - DNA, 20 bp, Artificial sequence
  Synthetic oligonucleotide
tctgcttttttttttttaca

SEQ ID NO: 130 - DNA, 20 bp, Artificial sequence
  Synthetic oligonucleotide
aagtactttcagcataggaa

SEQ ID NO: 131 - DNA, 20 bp, Artificial sequence
  Synthetic oligonucleotide
cgtatttattctggcctctt

SEQ ID NO: 132 - DNA, 20 bp, Artificial sequence
  Synthetic oligonucleotide
aatacagttgaaccatttgt

SEQ ID NO: 133 - DNA, 20 bp, Artificial sequence
  Synthetic oligonucleotide
acagcttgagctagtgtcac

SEQ ID NO: 134 - DNA, 20 bp, Artificial sequence
  Synthetic oligonucleotide
tggtgtctgttttcccttgg

SEQ ID NO: 135 - DNA, 20 bp, Artificial sequence
  Synthetic oligonucleotide
ggaattacagagagtatgca

SEQ ID NO: 136 - DNA, 20 bp, Artificial sequence
  Synthetic oligonucleotide
gttttattataataatgaaa

SEQ ID NO: 137 - DNA, 20 bp, Artificial sequence
  Synthetic oligonucleotide
gtagtagtttttgtgaggta

SEQ ID NO: 138 - DNA, 20 bp, Artificial sequence
  Synthetic oligonucleotide
gtcaccttttctatttgcac

SEQ ID NO: 139 - DNA, 20 bp, Artificial sequence
  Synthetic oligonucleotide
attttgacttttgattggtg

SEQ ID NO: 140 - DNA, 20 bp, Artificial sequence
  Synthetic oligonucleotide
gggactctgtctttatttcc

SEQ ID NO: 141 - DNA, 20 bp, Artificial sequence
  Synthetic oligonucleotide
atgtttctatctaagtccca

SEQ ID NO: 142 - DNA, 20 bp, Artificial sequence
  Synthetic oligonucleotide
gtgtgcatttttaattttgt

SEQ ID NO: 143 - DNA, 20 bp, Artificial sequence
  Synthetic oligonucleotide
tgaggacatcatgatggtgc

SEQ ID NO: 144 - DNA, 20 bp, Artificial sequence
  Synthetic oligonucleotide
gttttgtttcagtattaggt

SEQ ID NO: 145 - DNA, 20 bp, Artificial sequence
  Synthetic oligonucleotide
tacatcctgaaaatcacagc

SEQ ID NO: 146 - DNA, 20 bp, Artificial sequence
  Synthetic oligonucleotide
ctctcacttttcttctcctt

SEQ ID NO: 147 - DNA, 20 bp, Artificial sequence
  Synthetic oligonucleotide
gtctccttacatagtgctgc

SEQ ID NO: 148 - DNA, 20 bp, Artificial sequence
  Synthetic oligonucleotide
atatattagactaatatata

SEQ ID NO: 149 - DNA, 20 bp, Artificial sequence
  Synthetic oligonucleotide
tcaggtttatatgtatacaa

SEQ ID NO: 150 - DNA, 20 bp, Artificial sequence
  Synthetic oligonucleotide
gtttgtttagatttatcctc

SEQ ID NO: 151 - DNA, 20 bp, Artificial sequence
  Synthetic oligonucleotide
gtcatagctctcctctgcac

SEQ ID NO: 152 - DNA, 20 bp, Artificial sequence
  Synthetic oligonucleotide
gtcagcatacttagcttttc

SEQ ID NO: 153 - DNA, 20 bp, Artificial sequence
  Synthetic oligonucleotide
cagggctggactgagaggca

SEQ ID NO: 154 - DNA, 20 bp, Artificial sequence
  Synthetic oligonucleotide
tgagactattatagtttcca

SEQ ID NO: 155 - DNA, 20 bp, Artificial sequence
  Synthetic oligonucleotide
taaaatgcaccaatcaacgc

SEQ ID NO: 156 - DNA, 20 bp, Artificial sequence
  Synthetic oligonucleotide
gttactttatttctctaggg

SEQ ID NO: 157 - DNA, 20 bp, Artificial sequence
  Synthetic oligonucleotide
atttgtcttgttgtatgttg

SEQ ID NO: 158 - DNA, 20 bp, Artificial sequence
  Synthetic oligonucleotide
gttattttaaatagtggcct

SEQ ID NO: 159 - DNA, 20 bp, Artificial sequence
  Synthetic oligonucleotide
tctttggcttttagacctgt

SEQ ID NO: 160 - DNA, 20 bp, Artificial sequence
  Synthetic oligonucleotide
atgttatatcaatgttctgt

SEQ ID NO: 161 - DNA, 20 bp, Artificial sequence
  Synthetic oligonucleotide
gtctcagctcaagagtctgt

SEQ ID NO: 162 - DNA, 20 bp, Artificial sequence
  Synthetic oligonucleotide
tggcctgtatatctatggac

SEQ ID NO: 163 - DNA, 20 bp, Artificial sequence
  Synthetic oligonucleotide
tcagccatagctcactacag

SEQ ID NO: 164 - DNA, 20 bp, Artificial sequence
  Synthetic oligonucleotide
gtcccatttgaatgttttca

SEQ ID NO: 165 - DNA, 20 bp, Artificial sequence
  Synthetic oligonucleotide
tcactcatgtttattttcca

SEQ ID NO: 166 - DNA, 20 bp, Artificial sequence
  Synthetic oligonucleotide
tctgaatttctctgtgggtg

SEQ ID NO: 167 - DNA, 20 bp, Artificial sequence
  Synthetic oligonucleotide
tgtactcttcagagaagctg

SEQ ID NO: 168 - DNA, 20 bp, Artificial sequence
  Synthetic oligonucleotide
gttaggtgtgtgagacctct

SEQ ID NO: 169 - DNA, 20 bp, Artificial sequence
  Synthetic oligonucleotide
tctgtgagtgttctatttaa

SEQ ID NO: 170 - DNA, 20 bp, Artificial sequence
  Synthetic oligonucleotide
tggtgctatgtctatataca

SEQ ID NO: 171 - DNA, 20 bp, Artificial sequence
  Synthetic oligonucleotide
tggcctttatacttttgtaa

SEQ ID NO: 172 - DNA, 20 bp, Artificial sequence
  Synthetic oligonucleotide
tgtatatttgtctgttttgc

SEQ ID NO: 173 - DNA, 20 bp, Artificial sequence
  Synthetic oligonucleotide
cttcctttttttattttgag

SEQ ID NO: 174 - DNA, 20 bp, Artificial sequence
  Synthetic oligonucleotide
tctttattttataattaggt

SEQ ID NO: 175 - DNA, 20 bp, Artificial sequence
  Synthetic oligonucleotide
tctatggtcctcagtctcct

SEQ ID NO: 176 - DNA, 20 bp, Artificial sequence
  Synthetic oligonucleotide
gtgacactatttggtttcaa

SEQ ID NO: 177 - DNA, 20 bp, Artificial sequence
  Synthetic oligonucleotide
gcttttctacttcatcttct

SEQ ID NO: 178 - DNA, 20 bp, Artificial sequence
  Synthetic oligonucleotide
tgggcttttgatagtgttaa

SEQ ID NO: 179 - DNA, 20 bp, Artificial sequence
  Synthetic oligonucleotide
gttgctctggctgctgctcc

SEQ ID NO: 180 - DNA, 20 bp, Artificial sequence
  Synthetic oligonucleotide
tctctcttgttcctggtctg

SEQ ID NO: 181 - DNA, 20 bp, Artificial sequence
  Synthetic oligonucleotide
gcttgagtagaaagggtggc

SEQ ID NO: 182 - DNA, 20 bp, Artificial sequence
  Synthetic oligonucleotide
gtcacatttgatttctgtag

SEQ ID NO: 183 - DNA, 20 bp, Artificial sequence
  Synthetic oligonucleotide
tggttggatttcatttttcg

SEQ ID NO: 184 - DNA, 20 bp, Artificial sequence
  Synthetic oligonucleotide
gctgctgctgctcagccttg

SEQ ID NO: 185 - DNA, 20 bp, Artificial sequence
  Synthetic oligonucleotide
ggctgctctcagctttcttg

SEQ ID NO: 186 - DNA, 20 bp, Artificial sequence
  Synthetic oligonucleotide
gttgaagttctcgctcttgg

SEQ ID NO: 187 - DNA, 20 bp, Artificial sequence
  Synthetic oligonucleotide
ttctgtttttaagtcttcca

SEQ ID NO: 188 - DNA, 20 bp, Artificial sequence
  Synthetic oligonucleotide
cggcgaactgtatcacggcc

SEQ ID NO: 189 - DNA, 20 bp, Artificial sequence
  Synthetic oligonucleotide
actcccctggttgattccgt

SEQ ID NO: 190 - DNA, 20 bp, Artificial sequence
  Synthetic oligonucleotide
ctgtgttattttagcctaca

SEQ ID NO: 191 - DNA, 20 bp, Artificial sequence
  Synthetic oligonucleotide
gttcctgatgttgattttgc

SEQ ID NO: 192 - DNA, 20 bp, Artificial sequence
  Synthetic oligonucleotide
gtgttcgctctctccctctc

SEQ ID NO: 193 - DNA, 20 bp, Artificial sequence
  Synthetic oligonucleotide
tttttgtttttgttttttcc

SEQ ID NO: 194 - DNA, 20 bp, Artificial sequence
  Synthetic oligonucleotide
ggtcatttattgtcacatac

SEQ ID NO: 195 - DNA, 20 bp, Artificial sequence
  Synthetic oligonucleotide
actgcaggaatatcacacaa

SEQ ID NO: 196 - DNA, 20 bp, Artificial sequence
  Synthetic oligonucleotide
gtttagttgcagccatccaa

SEQ ID NO: 197 - DNA, 20 bp, Artificial sequence
  Synthetic oligonucleotide
gggttgataccagatttttt

SEQ ID NO: 198 - DNA, 20 bp, Artificial sequence
  Synthetic oligonucleotide
tggtgtgtgtttttctgagt

SEQ ID NO: 199 - DNA, 20 bp, Artificial sequence
  Synthetic oligonucleotide
attttataattcctatacct

SEQ ID NO: 200 - DNA, 20 bp, Artificial sequence
  Synthetic oligonucleotide
cattcactattccgtgtggt

SEQ ID NO: 201 - DNA, 20 bp, Artificial sequence
  Synthetic oligonucleotide
gtgattgtgttccattgtaa

SEQ ID NO: 202 - DNA, 20 bp, Artificial sequence
  Synthetic oligonucleotide
ttcttgtttgttggtttctt

SEQ ID NO: 203 - DNA, 20 bp, Artificial sequence
  Synthetic oligonucleotide
tcacaattccaagttagaaa

SEQ ID NO: 204 - DNA, 20 bp, Artificial sequence
  Synthetic oligonucleotide
gtaccgagagctctgcttcc

SEQ ID NO: 205 - DNA, 20 bp, Artificial sequence
  Synthetic oligonucleotide
gtgttcttaaattctctatt

SEQ ID NO: 206 - DNA, 20 bp, Artificial sequence
  Synthetic oligonucleotide
tgttttcttcagcttctcaa

SEQ ID NO: 207 - DNA, 20 bp, Artificial sequence
  Synthetic oligonucleotide
ctctgcttttttttttttac

SEQ ID NO: 208 - DNA, 20 bp, Artificial sequence
  Synthetic oligonucleotide
gtttagactaagaagggagc

SEQ ID NO: 209 - DNA, 20 bp, Artificial sequence
  Synthetic oligonucleotide
tccgtatttattctggcctc

SEQ ID NO: 210 - DNA, 20 bp, Artificial sequence
  Synthetic oligonucleotide
agatactacctattggccaa

SEQ ID NO: 211 - DNA, 20 bp, Artificial sequence
  Synthetic oligonucleotide
gcaccgagcttcttggtaac

SEQ ID NO: 212 - DNA, 20 bp, Artificial sequence
  Synthetic oligonucleotide
gttctggtgtctgttttccc

SEQ ID NO: 213 - DNA, 20 bp, Artificial sequence
  Synthetic oligonucleotide
gtacaatattttacactgga

SEQ ID NO: 214 - DNA, 20 bp, Artificial sequence
  Synthetic oligonucleotide
atttatttaaaacaattttg

SEQ ID NO: 215 - DNA, 20 bp, Artificial sequence
  Synthetic oligonucleotide
cttgtagtagtttttgtgag

SEQ ID NO: 216 - DNA, 20 bp, Artificial sequence
  Synthetic oligonucleotide
ggagggtgcttagtccttcc

SEQ ID NO: 217 - DNA, 20 bp, Artificial sequence
  Synthetic oligonucleotide
gtttggcacacagtaggtgc

SEQ ID NO: 218 - DNA, 20 bp, Artificial sequence
  Synthetic oligonucleotide
gtgactgctgctgatacctg

SEQ ID NO: 219 - DNA, 20 bp, Artificial sequence
  Synthetic oligonucleotide
gtttgatatgctatgctcac

SEQ ID NO: 220 - DNA, 20 bp, Artificial sequence
  Synthetic oligonucleotide
tgtttggttgaagtatgtgg

SEQ ID NO: 221 - DNA, 20 bp, Artificial sequence
  Synthetic oligonucleotide
atgtgggtatttaatgtttc

SEQ ID NO: 222 - DNA, 20 bp, Artificial sequence
  Synthetic oligonucleotide
gtctttctaaatggttgtac

SEQ ID NO: 223 - DNA, 20 bp, Artificial sequence
  Synthetic oligonucleotide
ttcagcatgatctcagttct

SEQ ID NO: 224 - DNA, 20 bp, Artificial sequence
  Synthetic oligonucleotide
atgacataattctaataact

SEQ ID NO: 225 - DNA, 20 bp, Artificial sequence
  Synthetic oligonucleotide
tctccttatcttgtcctctc

SEQ ID NO: 226 - DNA, 20 bp, Artificial sequence
  Synthetic oligonucleotide
tattatatattagactaata

SEQ ID NO: 227 - DNA, 20 bp, Artificial sequence
  Synthetic oligonucleotide
gttctattttataatagtag

SEQ ID NO: 228 - DNA, 20 bp, Artificial sequence
  Synthetic oligonucleotide
tgtgtaatactccatttttc

SEQ ID NO: 229 - DNA, 20 bp, Artificial sequence
  Synthetic oligonucleotide
gtttgtgttgtgttttacag

SEQ ID NO: 230 - DNA, 20 bp, Artificial sequence
  Synthetic oligonucleotide
gttttcatacacagttcttc

SEQ ID NO: 231 - DNA, 20 bp, Artificial sequence
  Synthetic oligonucleotide
attatattacattatacttg

SEQ ID NO: 232 - DNA, 20 bp, Artificial sequence
  Synthetic oligonucleotide
tcctgggtttttagttttcc

SEQ ID NO: 233 - DNA, 20 bp, Artificial sequence
  Synthetic oligonucleotide
tgaggattacatcagtgtaa

SEQ ID NO: 234 - DNA, 20 bp, Artificial sequence
  Synthetic oligonucleotide
tcttgggtagatgaggtttg

SEQ ID NO: 235 - DNA, 20 bp, Artificial sequence
  Synthetic oligonucleotide
tcttgttttttcctttcttg

SEQ ID NO: 236 - DNA, 20 bp, Artificial sequence
  Synthetic oligonucleotide
gtctcctttgttccgtgtac

SEQ ID NO: 237 - DNA, 20 bp, Artificial sequence
  Synthetic oligonucleotide
gtctttttatttctctgccc

SEQ ID NO: 238 - DNA, 20 bp, Artificial sequence
  Synthetic oligonucleotide
ttgcaagaaggtatgcctag

SEQ ID NO: 239 - DNA, 20 bp, Artificial sequence
  Synthetic oligonucleotide
tcctgtttacaacaaagctc

SEQ ID NO: 240 - DNA, 20 bp, Artificial sequence
  Synthetic oligonucleotide
tctttctttgctataatttc

SEQ ID NO: 241 - DNA, 20 bp, Artificial sequence
  Synthetic oligonucleotide
gtctgctgatctatctgttg

SEQ ID NO: 242 - DNA, 20 bp, Artificial sequence
  Synthetic oligonucleotide
attagtttatcttttttttc

SEQ ID NO: 243 - DNA, 20 bp, Artificial sequence
  Synthetic oligonucleotide
ctgtcagtagagagatttag

SEQ ID NO: 244 - DNA, 20 bp, Artificial sequence
  Synthetic oligonucleotide
tgcacatttctgaatttctc

SEQ ID NO: 245 - DNA, 20 bp, Artificial sequence
  Synthetic oligonucleotide
gtaccagctaatccattcaa

SEQ ID NO: 246 - DNA, 20 bp, Artificial sequence
  Synthetic oligonucleotide
tgttctgtataataatgtaa

SEQ ID NO: 247 - DNA, 20 bp, Artificial sequence
  Synthetic oligonucleotide
cgagagacccatttactgca

SEQ ID NO: 248 - DNA, 20 bp, Artificial sequence
  Synthetic oligonucleotide
tgggctcataattatttttt

SEQ ID NO: 249 - DNA, 20 bp, Artificial sequence
  Synthetic oligonucleotide
aagtcattttatgatcttgc

SEQ ID NO: 250 - DNA, 20 bp, Artificial sequence
  Synthetic oligonucleotide
atttacttgtatatttgtct

SEQ ID NO: 251 - DNA, 20 bp, Artificial sequence
  Synthetic oligonucleotide
gtttccatagcttccttttt

SEQ ID NO: 252 - DNA, 20 bp, Artificial sequence
  Synthetic oligonucleotide
tctcaaataggtacactcaa

SEQ ID NO: 253 - DNA, 20 bp, Artificial sequence
  Synthetic oligonucleotide
ttttgtttaaagggttttac

SEQ ID NO: 254 - DNA, 20 bp, Artificial sequence
  Synthetic oligonucleotide
gtgtgacactatttggtttc

SEQ ID NO: 255 - DNA, 20 bp, Artificial sequence
  Synthetic oligonucleotide
attgttgcttttctacttca

SEQ ID NO: 256 - DNA, 20 bp, Artificial sequence
  Synthetic oligonucleotide
aagtgggcttttgatagtgt

SEQ ID NO: 257 - DNA, 20 bp, Artificial sequence
  Synthetic oligonucleotide
tgctgttgctctggctgctg

SEQ ID NO: 258 - DNA, 20 bp, Artificial sequence
  Synthetic oligonucleotide
tctttctctcttgttcctgg

SEQ ID NO: 259 - DNA, 20 bp, Artificial sequence
  Synthetic oligonucleotide
tcttttcacgaagattttgc

SEQ ID NO: 260 - DNA, 20 bp, Artificial sequence
  Synthetic oligonucleotide
aagtcacatttgatttctgt

SEQ ID NO: 261 - DNA, 20 bp, Artificial sequence
  Synthetic oligonucleotide
tcttggttggatttcatttt

SEQ ID NO: 262 - DNA, 20 bp, Artificial sequence
  Synthetic oligonucleotide
tgaggtgctgctgctgctgc

SEQ ID NO: 263 - DNA, 20 bp, Artificial sequence
  Synthetic oligonucleotide
tggcctgctgcagccggctg

SEQ ID NO: 264 - DNA, 20 bp, Artificial sequence
  Synthetic oligonucleotide
ggttgaagttctcgctcttg

SEQ ID NO: 265 - DNA, 20 bp, Artificial sequence
  Synthetic oligonucleotide
tcttctgtttttaagtcttc

SEQ ID NO: 266 - DNA, 20 bp, Artificial sequence
  Synthetic oligonucleotide
tggctggttctctccggaca

SEQ ID NO: 267 - DNA, 20 bp, Artificial sequence
  Synthetic oligonucleotide
tgctgggttctattttggtg

SEQ ID NO: 268 - DNA, 20 bp, Artificial sequence
  Synthetic oligonucleotide
atgtaaatactgtgttattt

SEQ ID NO: 269 - DNA, 20 bp, Artificial sequence
  Synthetic oligonucleotide
ggttcctgatgttgattttg

SEQ ID NO: 270 - DNA, 20 bp, Artificial sequence
  Synthetic oligonucleotide
tgggtgttcgctctctccct

SEQ ID NO: 271 - DNA, 20 bp, Artificial sequence
  Synthetic oligonucleotide
aaagcaacttagtttttttt

SEQ ID NO: 272 - DNA, 20 bp, Artificial sequence
  Synthetic oligonucleotide
gtagtacttggtggtcattt

SEQ ID NO: 273 - DNA, 20 bp, Artificial sequence
  Synthetic oligonucleotide
tgctacatttatttatgctc

SEQ ID NO: 274 - DNA, 20 bp, Artificial sequence
  Synthetic oligonucleotide
tgttcagtttagttgcagcc

SEQ ID NO: 275 - DNA, 20 bp, Artificial sequence
  Synthetic oligonucleotide
aatactagacagccaaaatg

SEQ ID NO: 276 - DNA, 20 bp, Artificial sequence
  Synthetic oligonucleotide
aggtggtgtgtgtttttctg

SEQ ID NO: 277 - DNA, 20 bp, Artificial sequence
  Synthetic oligonucleotide
attattttataattcctata

SEQ ID NO: 278 - DNA, 20 bp, Artificial sequence
  Synthetic oligonucleotide
tccaggctacatggctccag

SEQ ID NO: 279 - DNA, 20 bp, Artificial sequence
  Synthetic oligonucleotide
atttttttcttttcgccctg

SEQ ID NO: 280 - DNA, 20 bp, Artificial sequence
  Synthetic oligonucleotide
aggttcttgtttgttggttt

SEQ ID NO: 281 - DNA, 20 bp, Artificial sequence
  Synthetic oligonucleotide
atagaggctcacaattccaa

SEQ ID NO: 282 - DNA, 20 bp, Artificial sequence
  Synthetic oligonucleotide
tgttgagctgcttgtggttc

SEQ ID NO: 283 - DNA, 20 bp, Artificial sequence
  Synthetic oligonucleotide
tgatgtgttcttaaattctc

SEQ ID NO: 284 - DNA, 20 bp, Artificial sequence
  Synthetic oligonucleotide
ttttgttttcttcagcttct

SEQ ID NO: 285 - DNA, 20 bp, Artificial sequence
  Synthetic oligonucleotide
ttctctgctttttttttttt

SEQ ID NO: 286 - DNA, 20 bp, Artificial sequence
  Synthetic oligonucleotide
caagattatattctttgggt

SEQ ID NO: 287 - DNA, 20 bp, Artificial sequence
  Synthetic oligonucleotide
tgctccgtatttattctggc

SEQ ID NO: 288 - DNA, 20 bp, Artificial sequence
  Synthetic oligonucleotide
gttattgtatagatactacc

SEQ ID NO: 289 - DNA, 20 bp, Artificial sequence
  Synthetic oligonucleotide
gcactaactaaaggatttac

SEQ ID NO: 290 - DNA, 20 bp, Artificial sequence
  Synthetic oligonucleotide
aacccaagttctggtgtctg

SEQ ID NO: 291 - DNA, 20 bp, Artificial sequence
  Synthetic oligonucleotide
gtgcaagtacaatattttac

SEQ ID NO: 292 - DNA, 20 bp, Artificial sequence
  Synthetic oligonucleotide
attttattagtacgagtata

SEQ ID NO: 293 - DNA, 20 bp, Artificial sequence
  Synthetic oligonucleotide
gtgcttgtagtagtttttgt

SEQ ID NO: 294 - DNA, 20 bp, Artificial sequence
  Synthetic oligonucleotide
gttagtggagggtgcttagt

SEQ ID NO: 295 - DNA, 20 bp, Artificial sequence
  Synthetic oligonucleotide
tcctgttattttggtactgg

SEQ ID NO: 296 - DNA, 20 bp, Artificial sequence
  Synthetic oligonucleotide
gtttgcctactcctggtctg

SEQ ID NO: 297 - DNA, 20 bp, Artificial sequence
  Synthetic oligonucleotide
gttgactatcttattttttc

SEQ ID NO: 298 - DNA, 20 bp, Artificial sequence
  Synthetic oligonucleotide
tcttgcttttaatttttttg

SEQ ID NO: 299 - DNA, 20 bp, Artificial sequence
  Synthetic oligonucleotide
gttcacctacatgtttcccc

SEQ ID NO: 300 - DNA, 20 bp, Artificial sequence
  Synthetic oligonucleotide
tcttttttttttaattacag

SEQ ID NO: 301 - DNA, 20 bp, Artificial sequence
  Synthetic oligonucleotide
tggtgcactcagctctacct

SEQ ID NO: 302 - DNA, 20 bp, Artificial sequence
  Synthetic oligonucleotide
aaaaatcctgatcaaaaaaa

SEQ ID NO: 303 - DNA, 20 bp, Artificial sequence
  Synthetic oligonucleotide
ggctccatactccattctgt

SEQ ID NO: 304 - DNA, 20 bp, Artificial sequence
  Synthetic oligonucleotide
tgtataatattccattctgt

SEQ ID NO: 305 - DNA, 20 bp, Artificial sequence
  Synthetic oligonucleotide
attttattacatttttcttg

SEQ ID NO: 306 - DNA, 20 bp, Artificial sequence
  Synthetic oligonucleotide
tctatgttagtcatttctct

SEQ ID NO: 307 - DNA, 20 bp, Artificial sequence
  Synthetic oligonucleotide
tcttgacatgatgtttccct

SEQ ID NO: 308 - DNA, 20 bp, Artificial sequence
  Synthetic oligonucleotide
attaccttaaaactaccttg

SEQ ID NO: 309 - DNA, 20 bp, Artificial sequence
  Synthetic oligonucleotide
taagccatgcctggacttcg

SEQ ID NO: 310 - DNA, 20 bp, Artificial sequence
  Synthetic oligonucleotide
gtttgcattaaatgactgtg

SEQ ID NO: 311 - DNA, 20 bp, Artificial sequence
  Synthetic oligonucleotide
tgtttgatatttcttttttt

SEQ ID NO: 312 - DNA, 20 bp, Artificial sequence
  Synthetic oligonucleotide
tcttgggtaactagatgatg

SEQ ID NO: 313 - DNA, 20 bp, Artificial sequence
  Synthetic oligonucleotide
gtttttttttttatttgcct

SEQ ID NO: 314 - DNA, 20 bp, Artificial sequence
  Synthetic oligonucleotide
gtcaggttataatgaccctg

SEQ ID NO: 315 - DNA, 20 bp, Artificial sequence
  Synthetic oligonucleotide
tcttctgtatttaattcttc

SEQ ID NO: 316 - DNA, 20 bp, Artificial sequence
  Synthetic oligonucleotide
gttattgtgtttatattcag

SEQ ID NO: 317 - DNA, 20 bp, Artificial sequence
  Synthetic oligonucleotide
tggtgacatcttgtttctac

SEQ ID NO: 318 - DNA, 20 bp, Artificial sequence
  Synthetic oligonucleotide
tgagccactgtgtgtagcca

SEQ ID NO: 319 - DNA, 20 bp, Artificial sequence
  Synthetic oligonucleotide
ttgtctgctgatctatctgt

SEQ ID NO: 320 - DNA, 20 bp, Artificial sequence
  Synthetic oligonucleotide
gttttttatttttaaattag

SEQ ID NO: 321 - DNA, 20 bp, Artificial sequence
  Synthetic oligonucleotide
ccttgcacttttgtttctac

SEQ ID NO: 322 - DNA, 20 bp, Artificial sequence
  Synthetic oligonucleotide
tcagtacatgttcatcttaa

SEQ ID NO: 323 - DNA, 20 bp, Artificial sequence
  Synthetic oligonucleotide
cggcatgttcaatgttggca

SEQ ID NO: 324 - DNA, 20 bp, Artificial sequence
  Synthetic oligonucleotide
gtgagctattatggtgtcac

SEQ ID NO: 325 - DNA, 20 bp, Artificial sequence
  Synthetic oligonucleotide
gtctgctttcctggaaggct

SEQ ID NO: 326 - DNA, 20 bp, Artificial sequence
  Synthetic oligonucleotide
atccccctaaatcgactcct

SEQ ID NO: 327 - DNA, 20 bp, Artificial sequence
  Synthetic oligonucleotide
gttattttctctccactctc

SEQ ID NO: 328 - DNA, 20 bp, Artificial sequence
  Synthetic oligonucleotide
attcttttttatttacttgt

SEQ ID NO: 329 - DNA, 20 bp, Artificial sequence
  Synthetic oligonucleotide
tctagtttccatagcttcct

SEQ ID NO: 330 - DNA, 20 bp, Artificial sequence
  Synthetic oligonucleotide
tctttgtttctttttgccta

SEQ ID NO: 331 - DNA, 20 bp, Artificial sequence
  Synthetic oligonucleotide
tccatttttgtttaaagggt

SEQ ID NO: 332 - DNA, 20 bp, Artificial sequence
  Synthetic oligonucleotide
tggtacagataattgtgatg

SEQ ID NO: 333 - DNA, 20 bp, Artificial sequence
  Synthetic oligonucleotide
tggattttatacacattcag

SEQ ID NO: 334 - DNA, 20 bp, Artificial sequence
  Synthetic oligonucleotide
cttagattttatgagctcaa

SEQ ID NO: 335 - DNA, 20 bp, Artificial sequence
  Synthetic oligonucleotide
gctgctgttgctctggctgc

SEQ ID NO: 336 - DNA, 20 bp, Artificial sequence
  Synthetic oligonucleotide
ctctttctctcttgttcctg

SEQ ID NO: 337 - DNA, 20 bp, Artificial sequence
  Synthetic oligonucleotide
accataagctatcagttcct

SEQ ID NO: 338 - DNA, 20 bp, Artificial sequence
  Synthetic oligonucleotide
gtctggatggctctgatttt

SEQ ID NO: 339 - DNA, 20 bp, Artificial sequence
  Synthetic oligonucleotide
tccgctcttggttggatttc

SEQ ID NO: 340 - DNA, 20 bp, Artificial sequence
  Synthetic oligonucleotide
tgctgaggtgctgctgctgc

SEQ ID NO: 341 - DNA, 20 bp, Artificial sequence
  Synthetic oligonucleotide
gttcaggacctccttggcct

SEQ ID NO: 342 - DNA, 20 bp, Artificial sequence
  Synthetic oligonucleotide
ctcagggttgaagttctcgc

SEQ ID NO: 343 - DNA, 20 bp, Artificial sequence
  Synthetic oligonucleotide
tgcactctggatgaaatctt

SEQ ID NO: 344 - DNA, 20 bp, Artificial sequence
  Synthetic oligonucleotide
cttcaggttcttgagggtaa

SEQ ID NO: 345 - DNA, 20 bp, Artificial sequence
  Synthetic oligonucleotide
gcttgctgggttctattttg

SEQ ID NO: 346 - DNA, 20 bp, Artificial sequence
  Synthetic oligonucleotide
cctgctgtaactctaatgac

SEQ ID NO: 347 - DNA, 20 bp, Artificial sequence
  Synthetic oligonucleotide
tggttaactttccaaatctg

SEQ ID NO: 348 - DNA, 20 bp, Artificial sequence
  Synthetic oligonucleotide
gttttcctaacactgcacag

SEQ ID NO: 349 - DNA, 20 bp, Artificial sequence
  Synthetic oligonucleotide
atgtagttacagtgttgaaa

SEQ ID NO: 350 - DNA, 20 bp, Artificial sequence
  Synthetic oligonucleotide
caggtagtacttggtggtca

SEQ ID NO: 351 - DNA, 20 bp, Artificial sequence
  Synthetic oligonucleotide
attttgctacatttatttat

SEQ ID NO: 352 - DNA, 20 bp, Artificial sequence
  Synthetic oligonucleotide
gtatttgttcagtttagttg

SEQ ID NO: 353 - DNA, 20 bp, Artificial sequence
  Synthetic oligonucleotide
gctattctaaacctattcaa

SEQ ID NO: 354 - DNA, 20 bp, Artificial sequence
  Synthetic oligonucleotide
ggtttagtggatccagtcaa

SEQ ID NO: 355 - DNA, 20 bp, Artificial sequence
  Synthetic oligonucleotide
aagtgtttagaaagaaccaa

SEQ ID NO: 356 - DNA, 20 bp, Artificial sequence
  Synthetic oligonucleotide
tggcaggtggtcccctccac

SEQ ID NO: 357 - DNA, 20 bp, Artificial sequence
  Synthetic oligonucleotide
atagtattatttttttcttt

SEQ ID NO: 358 - DNA, 20 bp, Artificial sequence
  Synthetic oligonucleotide
agagaggttcttgtttgttg

SEQ ID NO: 359 - DNA, 20 bp, Artificial sequence
  Synthetic oligonucleotide
tgctgccacttcctggtggg

SEQ ID NO: 360 - DNA, 20 bp, Artificial sequence
  Synthetic oligonucleotide
gtctgttgagctgcttgtgg

SEQ ID NO: 361 - DNA, 20 bp, Artificial sequence
  Synthetic oligonucleotide
ctctgtatatttattacttg

SEQ ID NO: 362 - DNA, 20 bp, Artificial sequence
  Synthetic oligonucleotide
attttgttttcttcagcttc

SEQ ID NO: 363 - DNA, 20 bp, Artificial sequence
  Synthetic oligonucleotide
ccttctctgctttttttttt

SEQ ID NO: 364 - DNA, 20 bp, Artificial sequence
  Synthetic oligonucleotide
gttcaagattatattctttg

SEQ ID NO: 365 - DNA, 20 bp, Artificial sequence
  Synthetic oligonucleotide
gtccggcttgatttttggac

SEQ ID NO: 366 - DNA, 20 bp, Artificial sequence
  Synthetic oligonucleotide
ttgttgttattgtatagata

SEQ ID NO: 367 - DNA, 20 bp, Artificial sequence
  Synthetic oligonucleotide
tttagagttgagcagttcag

SEQ ID NO: 368 - DNA, 20 bp, Artificial sequence
  Synthetic oligonucleotide
tgtcagtctggtagtgccct

SEQ ID NO: 369 - DNA, 20 bp, Artificial sequence
  Synthetic oligonucleotide
attttttaatatttgtttaa

SEQ ID NO: 370 - DNA, 20 bp, Artificial sequence
  Synthetic oligonucleotide
gttattttattagtacgagt

SEQ ID NO: 371 - DNA, 20 bp, Artificial sequence
  Synthetic oligonucleotide
ggtgcttgtagtagtttttg

SEQ ID NO: 372 - DNA, 20 bp, Artificial sequence
  Synthetic oligonucleotide
tcctccttttatatctgttt

SEQ ID NO: 373 - DNA, 20 bp, Artificial sequence
  Synthetic oligonucleotide
gtttgattactgtcatgact

SEQ ID NO: 374 - DNA, 20 bp, Artificial sequence
  Synthetic oligonucleotide
gtgaaaagaaagatgtactt

SEQ ID NO: 375 - DNA, 20 bp, Artificial sequence
  Synthetic oligonucleotide
cgttgactatcttatttttt

SEQ ID NO: 376 - DNA, 20 bp, Artificial sequence
  Synthetic oligonucleotide
tctcaattataatttgtttt

SEQ ID NO: 377 - DNA, 20 bp, Artificial sequence
  Synthetic oligonucleotide
gtttccttaaaagcaactgt

SEQ ID NO: 378 - DNA, 20 bp, Artificial sequence
  Synthetic oligonucleotide
agagtcaatgattaaattca

SEQ ID NO: 379 - DNA, 20 bp, Artificial sequence
  Synthetic oligonucleotide
catgactctttcttaagaat

SEQ ID NO: 380 - DNA, 20 bp, Artificial sequence
  Synthetic oligonucleotide
aaattttctagaaacattaa

SEQ ID NO: 381 - DNA, 20 bp, Artificial sequence
  Synthetic oligonucleotide
gttaccattctcctttcccc

SEQ ID NO: 382 - DNA, 20 bp, Artificial sequence
  Synthetic oligonucleotide
tgctagctacagagcactga

SEQ ID NO: 383 - DNA, 20 bp, Artificial sequence
  Synthetic oligonucleotide
cgttggatattttattcttt

SEQ ID NO: 384 - DNA, 20 bp, Artificial sequence
  Synthetic oligonucleotide
atgtttgtattccatatttg

SEQ ID NO: 385 - DNA, 20 bp, Artificial sequence
  Synthetic oligonucleotide
tcttttcatcttcagctctg

SEQ ID NO: 386 - DNA, 20 bp, Artificial sequence
  Synthetic oligonucleotide
gtttgtgcttttggtgtcac

SEQ ID NO: 387 - DNA, 20 bp, Artificial sequence
  Synthetic oligonucleotide
gtttgctttcttcatcctac

SEQ ID NO: 388 - DNA, 20 bp, Artificial sequence
  Synthetic oligonucleotide
aatcgcagggaggattgaaa

SEQ ID NO: 389 - DNA, 20 bp, Artificial sequence
  Synthetic oligonucleotide
tgacctttatttggatcttg

SEQ ID NO: 390 - DNA, 20 bp, Artificial sequence
  Synthetic oligonucleotide
tggcatttataatatttgtg

SEQ ID NO: 391 - DNA, 20 bp, Artificial sequence
  Synthetic oligonucleotide
attttcttagaaggatctct

SEQ ID NO: 392 - DNA, 20 bp, Artificial sequence
  Synthetic oligonucleotide
gtttgaactgagcatgtttt

SEQ ID NO: 393 - DNA, 20 bp, Artificial sequence
  Synthetic oligonucleotide
tggtcattagatcatgctac

SEQ ID NO: 394 - DNA, 20 bp, Artificial sequence
  Synthetic oligonucleotide
tgtagcttttagtgactttg

SEQ ID NO: 395 - DNA, 20 bp, Artificial sequence
  Synthetic oligonucleotide
attttggctttccatagtgt

SEQ ID NO: 396 - DNA, 20 bp, Artificial sequence
  Synthetic oligonucleotide
gttactgctgctgtgtgggc

SEQ ID NO: 397 - DNA, 20 bp, Artificial sequence
  Synthetic oligonucleotide
ctaggattagctaattccta

SEQ ID NO: 398 - DNA, 20 bp, Artificial sequence
  Synthetic oligonucleotide
tctctactaaaatgtttttt

SEQ ID NO: 399 - DNA, 20 bp, Artificial sequence
  Synthetic oligonucleotide
ggagtattttagctgtgatg

SEQ ID NO: 400 - DNA, 20 bp, Artificial sequence
  Synthetic oligonucleotide
gcttcctttggtgcacgcag

SEQ ID NO: 401 - DNA, 20 bp, Artificial sequence
  Synthetic oligonucleotide
gtttgacatagtttctctgt

SEQ ID NO: 402 - DNA, 20 bp, Artificial sequence
  Synthetic oligonucleotide
tggtgtgtacttgtggtccc

SEQ ID NO: 403 - DNA, 20 bp, Artificial sequence
  Synthetic oligonucleotide
gtttcagtaagtatgtcttg

SEQ ID NO: 404 - DNA, 20 bp, Artificial sequence
  Synthetic oligonucleotide
gttataagagatctgcctac

SEQ ID NO: 405 - DNA, 20 bp, Artificial sequence
  Synthetic oligonucleotide
atcacacttcagttattttc

SEQ ID NO: 406 - DNA, 20 bp, Artificial sequence
  Synthetic oligonucleotide
tcttcttatgcattcttttt

SEQ ID NO: 407 - DNA, 20 bp, Artificial sequence
  Synthetic oligonucleotide
ccacccactgtccttttcag

SEQ ID NO: 408 - DNA, 20 bp, Artificial sequence
  Synthetic oligonucleotide
attcttctttaatcacttca

SEQ ID NO: 409 - DNA, 20 bp, Artificial sequence
  Synthetic oligonucleotide
gtttgcttattcttgcccaa

SEQ ID NO: 410 - DNA, 20 bp, Artificial sequence
  Synthetic oligonucleotide
tccatggtacagataattgt

SEQ ID NO: 411 - DNA, 20 bp, Artificial sequence
  Synthetic oligonucleotide
gttggattctttttttcttt

SEQ ID NO: 412 - DNA, 20 bp, Artificial sequence
  Synthetic oligonucleotide
tctatagctggtctctgtta

SEQ ID NO: 413 - DNA, 20 bp, Artificial sequence
  Synthetic oligonucleotide
cttgcggctgctgttgctct

SEQ ID NO: 414 - DNA, 20 bp, Artificial sequence
  Synthetic oligonucleotide
actctttctctcttgttcct

SEQ ID NO: 415 - DNA, 20 bp, Artificial sequence
  Synthetic oligonucleotide
gtaccatgtgctttcatcac

SEQ ID NO: 416 - DNA, 20 bp, Artificial sequence
  Synthetic oligonucleotide
gtttcactgtctggatggct

SEQ ID NO: 417 - DNA, 20 bp, Artificial sequence
  Synthetic oligonucleotide
tgctccgctcttggttggat

SEQ ID NO: 418 - DNA, 20 bp, Artificial sequence
  Synthetic oligonucleotide
gtactggttctgctgggctg

SEQ ID NO: 419 - DNA, 20 bp, Artificial sequence
  Synthetic oligonucleotide
gccggctcttctccatctca

SEQ ID NO: 420 - DNA, 20 bp, Artificial sequence
  Synthetic oligonucleotide
ccttctttagctccccgttg

SEQ ID NO: 421 - DNA, 20 bp, Artificial sequence
  Synthetic oligonucleotide
tgcttatctctgcactctgg

SEQ ID NO: 422 - DNA, 20 bp, Artificial sequence
  Synthetic oligonucleotide
agagccgttcttcaggttct

SEQ ID NO: 423 - DNA, 20 bp, Artificial sequence
  Synthetic oligonucleotide
gccgaccacctcctcttcct

SEQ ID NO: 424 - DNA, 20 bp, Artificial sequence
  Synthetic oligonucleotide
tgcaccagtctcctgcgaca

SEQ ID NO: 425 - DNA, 20 bp, Artificial sequence
  Synthetic oligonucleotide
tgttcttttaaatggttaac

SEQ ID NO: 426 - DNA, 20 bp, Artificial sequence
  Synthetic oligonucleotide
gtttgcatctacctcttggg

SEQ ID NO: 427 - DNA, 20 bp, Artificial sequence
  Synthetic oligonucleotide
tgcagagctgaaatgtagtt

SEQ ID NO: 428 - DNA, 20 bp, Artificial sequence
  Synthetic oligonucleotide
cgtcaggtagtacttggtgg

SEQ ID NO: 429 - DNA, 20 bp, Artificial sequence
  Synthetic oligonucleotide
aatggcctagagtttaggca

SEQ ID NO: 430 - DNA, 20 bp, Artificial sequence
  Synthetic oligonucleotide
caggtatttgttcagtttag

SEQ ID NO: 431 - DNA, 20 bp, Artificial sequence
  Synthetic oligonucleotide
tcctcttaccatcaaaggct

SEQ ID NO: 432 - DNA, 20 bp, Artificial sequence
  Synthetic oligonucleotide
tgttggtttagtggatccag

SEQ ID NO: 433 - DNA, 20 bp, Artificial sequence
  Synthetic oligonucleotide
tggcacagaaagtattgcac

SEQ ID NO: 434 - DNA, 20 bp, Artificial sequence
  Synthetic oligonucleotide
gtggtgaccgtgggtggcag

SEQ ID NO: 435 - DNA, 20 bp, Artificial sequence
  Synthetic oligonucleotide
gtttcttattaatagtatta

SEQ ID NO: 436 - DNA, 20 bp, Artificial sequence
  Synthetic oligonucleotide
gtcattttatatatttagaa

SEQ ID NO: 437 - DNA, 20 bp, Artificial sequence
  Synthetic oligonucleotide
ggagggatgctgccacttcc

SEQ ID NO: 438 - DNA, 20 bp, Artificial sequence
  Synthetic oligonucleotide
cagtctgttgagctgcttgt

SEQ ID NO: 439 - DNA, 20 bp, Artificial sequence
  Synthetic oligonucleotide
ttctctgtatatttattact

SEQ ID NO: 440 - DNA, 20 bp, Artificial sequence
  Synthetic oligonucleotide
cttcaaaattttgttttctt

SEQ ID NO: 441 - DNA, 20 bp, Artificial sequence
  Synthetic oligonucleotide
tgacaaatttctatatacaa

SEQ ID NO: 442 - DNA, 20 bp, Artificial sequence
  Synthetic oligonucleotide
tgagtcctgtttgattggta

SEQ ID NO: 443 - DNA, 20 bp, Artificial sequence
  Synthetic oligonucleotide
gtttccactgtccggcttga

SEQ ID NO: 444 - DNA, 20 bp, Artificial sequence
  Synthetic oligonucleotide
tcttagagattgttgttatt

SEQ ID NO: 445 - DNA, 20 bp, Artificial sequence
  Synthetic oligonucleotide
atttgggtttagagttgagc

SEQ ID NO: 446 - DNA, 20 bp, Artificial sequence
  Synthetic oligonucleotide
tccctagttctcctctgtac

SEQ ID NO: 447 - DNA, 20 bp, Artificial sequence
  Synthetic oligonucleotide
tccattttttaatatttgtt

SEQ ID NO: 448 - DNA, 20 bp, Artificial sequence
  Synthetic oligonucleotide
ctgttattttattagtacga

SEQ ID NO: 449 - DNA, 20 bp, Artificial sequence
  Synthetic oligonucleotide
tggtgcttgtagtagttttt

SEQ ID NO: 450 - DNA, 20 bp, Artificial sequence
  Synthetic oligonucleotide
tcttcattttaatgttgttt

SEQ ID NO: 451 - DNA, 20 bp, Artificial sequence
  Synthetic oligonucleotide
tctgctctaaaactttctac

SEQ ID NO: 452 - DNA, 20 bp, Artificial sequence
  Synthetic oligonucleotide
ttattagtgaaaagaaagat

SEQ ID NO: 453 - DNA, 20 bp, Artificial sequence
  Synthetic oligonucleotide
attcagatataattgtttac

SEQ ID NO: 454 - DNA, 20 bp, Artificial sequence
  Synthetic oligonucleotide
gtgtgaataactaattcctt

SEQ ID NO: 455 - DNA, 20 bp, Artificial sequence
  Synthetic oligonucleotide
tgtttgataaatgttattct

SEQ ID NO: 456 - DNA, 20 bp, Artificial sequence
  Synthetic oligonucleotide
tattatattaaaagttaaaa

SEQ ID NO: 457 - DNA, 20 bp, Artificial sequence
  Synthetic oligonucleotide
agaggcttctggaaatcccc

SEQ ID NO: 458 - DNA, 20 bp, Artificial sequence
  Synthetic oligonucleotide
cctgtcttgataaaataaaa

SEQ ID NO: 459 - DNA, 20 bp, Artificial sequence
  Synthetic oligonucleotide
tgcatctattttctattctg

SEQ ID NO: 460 - DNA, 20 bp, Artificial sequence
  Synthetic oligonucleotide
gaaaattcctactcattttt

SEQ ID NO: 461 - DNA, 20 bp, Artificial sequence
  Synthetic oligonucleotide
gtttctgctaatctgtgaca

SEQ ID NO: 462 - DNA, 20 bp, Artificial sequence
  Synthetic oligonucleotide
gtttgcagttaacttttttt

SEQ ID NO: 463 - DNA, 20 bp, Artificial sequence
  Synthetic oligonucleotide
tggttatttactcattctac

SEQ ID NO: 464 - DNA, 20 bp, Artificial sequence
  Synthetic oligonucleotide
tcttttcataagcttattgg

SEQ ID NO: 465 - DNA, 20 bp, Artificial sequence
  Synthetic oligonucleotide
gtctgctttcaatgaagcac

SEQ ID NO: 466 - DNA, 20 bp, Artificial sequence
  Synthetic oligonucleotide
actttcctgtcttacaagag

SEQ ID NO: 467 - DNA, 20 bp, Artificial sequence
  Synthetic oligonucleotide
gtgagaactgctattttcag

SEQ ID NO: 468 - DNA, 20 bp, Artificial sequence
  Synthetic oligonucleotide
tcagctgtacagctccttac

SEQ ID NO: 469 - DNA, 20 bp, Artificial sequence
  Synthetic oligonucleotide
tggtcattatctagtttctg

SEQ ID NO: 470 - DNA, 20 bp, Artificial sequence
  Synthetic oligonucleotide
gtgtgtctagtttgtttttc

SEQ ID NO: 471 - DNA, 20 bp, Artificial sequence
  Synthetic oligonucleotide
gttatatatttcctattttc

SEQ ID NO: 472 - DNA, 20 bp, Artificial sequence
  Synthetic oligonucleotide
tctatatattaatcatttcc

SEQ ID NO: 473 - DNA, 20 bp, Artificial sequence
  Synthetic oligonucleotide
gggttatatcatgttggcca

SEQ ID NO: 474 - DNA, 20 bp, Artificial sequence
  Synthetic oligonucleotide
cggtgtggtgtcccatccct

SEQ ID NO: 475 - DNA, 20 bp, Artificial sequence
  Synthetic oligonucleotide
ctttgatattttagtgtctt

SEQ ID NO: 476 - DNA, 20 bp, Artificial sequence
  Synthetic oligonucleotide
tcctgattttcttttttttt

SEQ ID NO: 477 - DNA, 20 bp, Artificial sequence
  Synthetic oligonucleotide
tgctctctgtctgagtctcc

SEQ ID NO: 478 - DNA, 20 bp, Artificial sequence
  Synthetic oligonucleotide
gtgccagttcctgcattttc

SEQ ID NO: 479 - DNA, 20 bp, Artificial sequence
  Synthetic oligonucleotide
gtggtttgacatagtttctc

SEQ ID NO: 480 - DNA, 20 bp, Artificial sequence
  Synthetic oligonucleotide
gtttttcttacacatggtag

SEQ ID NO: 481 - DNA, 20 bp, Artificial sequence
  Synthetic oligonucleotide
ggtttcagtaagtatgtctt

SEQ ID NO: 482 - DNA, 20 bp, Artificial sequence
  Synthetic oligonucleotide
tgtggttataagagatctgc

SEQ ID NO: 483 - DNA, 20 bp, Artificial sequence
  Synthetic oligonucleotide
tcatgattttattgaatcac

SEQ ID NO: 484 - DNA, 20 bp, Artificial sequence
  Synthetic oligonucleotide
tctttataccagggatcccc

SEQ ID NO: 485 - DNA, 20 bp, Artificial sequence
  Synthetic oligonucleotide
tcatactttcttccgctctt

SEQ ID NO: 486 - DNA, 20 bp, Artificial sequence
  Synthetic oligonucleotide
gggtttcattcaccatgttg

SEQ ID NO: 487 - DNA, 20 bp, Artificial sequence
  Synthetic oligonucleotide
cggtttgcttattcttgccc

SEQ ID NO: 488 - DNA, 20 bp, Artificial sequence
  Synthetic oligonucleotide
attttcttttttctgtgcct

SEQ ID NO: 489 - DNA, 20 bp, Artificial sequence
  Synthetic oligonucleotide
tgttggattctttttttctt

SEQ ID NO: 490 - DNA, 20 bp, Artificial sequence
  Synthetic oligonucleotide
tgggttgtacctctacttgc

SEQ ID NO: 491 - DNA, 20 bp, Artificial sequence
  Synthetic oligonucleotide
tggtgacttgatgcacgatg

SEQ ID NO: 492 - DNA, 20 bp, Artificial sequence
  Synthetic oligonucleotide
tccactctttctctcttgtt

SEQ ID NO: 493 - DNA, 20 bp, Artificial sequence
  Synthetic oligonucleotide
tctttcttcctttcacagag

SEQ ID NO: 494 - DNA, 20 bp, Artificial sequence
  Synthetic oligonucleotide
gtgactgtttcactgtctgg

SEQ ID NO: 495 - DNA, 20 bp, Artificial sequence
  Synthetic oligonucleotide
cgttgctccgctcttggttg

SEQ ID NO: 496 - DNA, 20 bp, Artificial sequence
  Synthetic oligonucleotide
ggtggcctcccgagggacaa

SEQ ID NO: 497 - DNA, 20 bp, Artificial sequence
  Synthetic oligonucleotide
atcacgactgctgtagtctg

SEQ ID NO: 498 - DNA, 20 bp, Artificial sequence
  Synthetic oligonucleotide
tccaccttctttagctcccc

SEQ ID NO: 499 - DNA, 20 bp, Artificial sequence
  Synthetic oligonucleotide
cgttgcttatctctgcactc

SEQ ID NO: 500 - DNA, 20 bp, Artificial sequence
  Synthetic oligonucleotide
gtgtctgctgcccgccaggc

SEQ ID NO: 501 - DNA, 20 bp, Artificial sequence
  Synthetic oligonucleotide
ttctgacttctccagtttgc

SEQ ID NO: 502 - DNA, 20 bp, Artificial sequence
  Synthetic oligonucleotide
gtgcccttcctcccgcccgc

SEQ ID NO: 503 - DNA, 20 bp, Artificial sequence
  Synthetic oligonucleotide
tttattgtaaaatatgttgg

SEQ ID NO: 504 - DNA, 20 bp, Artificial sequence
  Synthetic oligonucleotide
ggcagtttgcatctacctct

SEQ ID NO: 505 - DNA, 20 bp, Artificial sequence
  Synthetic oligonucleotide
cttgctcttcagcaattctg

SEQ ID NO: 506 - DNA, 20 bp, Artificial sequence
  Synthetic oligonucleotide
atgccttgaactgattctca

SEQ ID NO: 507 - DNA, 20 bp, Artificial sequence
  Synthetic oligonucleotide
ctcacatatataaatgtctt

SEQ ID NO: 508 - DNA, 20 bp, Artificial sequence
  Synthetic oligonucleotide
aaagtactattttcaatggg

SEQ ID NO: 509 - DNA, 20 bp, Artificial sequence
  Synthetic oligonucleotide
cagcccgtattcctcttacc

SEQ ID NO: 510 - DNA, 20 bp, Artificial sequence
  Synthetic oligonucleotide
gtgttggtttagtggatcca

SEQ ID NO: 511 - DNA, 20 bp, Artificial sequence
  Synthetic oligonucleotide
tggtcagactctattggcac

SEQ ID NO: 512 - DNA, 20 bp, Artificial sequence
  Synthetic oligonucleotide
tgtttgctacacagaagcgg

SEQ ID NO: 513 - DNA, 20 bp, Artificial sequence
  Synthetic oligonucleotide
tggtttcttattaatagtat

SEQ ID NO: 514 - DNA, 20 bp, Artificial sequence
  Synthetic oligonucleotide
cagtcattttatatatttag

SEQ ID NO: 515 - DNA, 20 bp, Artificial sequence
  Synthetic oligonucleotide
gtgcaaagagtggattttat

SEQ ID NO: 516 - DNA, 20 bp, Artificial sequence
  Synthetic oligonucleotide
tggccctgttttcacctggt

SEQ ID NO: 517 - DNA, 20 bp, Artificial sequence
  Synthetic oligonucleotide
gtttggagtttccctatgcc

SEQ ID NO: 518 - DNA, 20 bp, Artificial sequence
  Synthetic oligonucleotide
tgagtgcttcaaaattttgt

SEQ ID NO: 519 - DNA, 20 bp, Artificial sequence
  Synthetic oligonucleotide
gtagtaattcttccaggcca

SEQ ID NO: 520 - DNA, 20 bp, Artificial sequence
  Synthetic oligonucleotide
tgtccccataatgagtcctg

SEQ ID NO: 521 - DNA, 20 bp, Artificial sequence
  Synthetic oligonucleotide
gtccagtttccactgtccgg

SEQ ID NO: 522 - DNA, 20 bp, Artificial sequence
  Synthetic oligonucleotide
ggacagtatgttatcttggt

SEQ ID NO: 523 - DNA, 20 bp, Artificial sequence
  Synthetic oligonucleotide
ggctgacactaatttgggtt

SEQ ID NO: 524 - DNA, 20 bp, Artificial sequence
  Synthetic oligonucleotide
ccttccctagttctcctctg

SEQ ID NO: 525 - DNA, 20 bp, Artificial sequence
  Synthetic oligonucleotide
cttccattttttaatatttg

SEQ ID NO: 526 - DNA, 20 bp, Artificial sequence
  Synthetic oligonucleotide
cactgttattttattagtac

SEQ ID NO: 527 - DNA, 20 bp, Artificial sequence
  Synthetic oligonucleotide
ataaaagttgagtagctaga

SEQ ID NO: 528 - DNA, 20 bp, Artificial sequence
  Synthetic oligonucleotide
tccgcattatttttccctgc

SEQ ID NO: 529 - DNA, 20 bp, Artificial sequence
  Synthetic oligonucleotide
tcctacttttaagtttccag

SEQ ID NO: 530 - DNA, 20 bp, Artificial sequence
  Synthetic oligonucleotide
aaactaatttattagtgaaa

SEQ ID NO: 531 - DNA, 20 bp, Artificial sequence
  Synthetic oligonucleotide
tgtatagtagaatttttttt

SEQ ID NO: 532 - DNA, 20 bp, Artificial sequence
  Synthetic oligonucleotide
gtgtgtttagttgtttgggt

SEQ ID NO: 533 - DNA, 20 bp, Artificial sequence
  Synthetic oligonucleotide
gttgagacttaattgctcag

SEQ ID NO: 534 - DNA, 20 bp, Artificial sequence
  Synthetic oligonucleotide
gaatactatgtatttgccac

SEQ ID NO: 535 - DNA, 20 bp, Artificial sequence
  Synthetic oligonucleotide
ttttgacaagtcagtctttt

SEQ ID NO: 536 - DNA, 20 bp, Artificial sequence
  Synthetic oligonucleotide
gtttccttaaaatatgttgg

SEQ ID NO: 537 - DNA, 20 bp, Artificial sequence
  Synthetic oligonucleotide
tccattgtatatgtatctgt

SEQ ID NO: 538 - DNA, 20 bp, Artificial sequence
  Synthetic oligonucleotide
gttatatttaatcatgttcc

SEQ ID NO: 539 - DNA, 20 bp, Artificial sequence
  Synthetic oligonucleotide
gtcatatttcttagtttctg

SEQ ID NO: 540 - DNA, 20 bp, Artificial sequence
  Synthetic oligonucleotide
gttatgtttaaggtattttc

SEQ ID NO: 541 - DNA, 20 bp, Artificial sequence
  Synthetic oligonucleotide
cgtcggataaatttatccac

SEQ ID NO: 542 - DNA, 20 bp, Artificial sequence
  Synthetic oligonucleotide
gttttctatagtgattgcac

SEQ ID NO: 543 - DNA, 20 bp, Artificial sequence
  Synthetic oligonucleotide
tctttttttcttttaaccct

SEQ ID NO: 544 - DNA, 20 bp, Artificial sequence
  Synthetic oligonucleotide
caatcaggaactttcctgtc

SEQ ID NO: 545 - DNA, 20 bp, Artificial sequence
  Synthetic oligonucleotide
aggaacacaagagggaatac

SEQ ID NO: 546 - DNA, 20 bp, Artificial sequence
  Synthetic oligonucleotide
tctttcctaaagcttattag

SEQ ID NO: 547 - DNA, 20 bp, Artificial sequence
  Synthetic oligonucleotide
gttttaactcagctctctct

SEQ ID NO: 548 - DNA, 20 bp, Artificial sequence
  Synthetic oligonucleotide
cggctagtatttatattttt

SEQ ID NO: 549 - DNA, 20 bp, Artificial sequence
  Synthetic oligonucleotide
gtctacatttatagatttag

SEQ ID NO: 550 - DNA, 20 bp, Artificial sequence
  Synthetic oligonucleotide
gtgttacataaattaattcc

SEQ ID NO: 551 - DNA, 20 bp, Artificial sequence
  Synthetic oligonucleotide
gttactgttcttatcttgtg

SEQ ID NO: 552 - DNA, 20 bp, Artificial sequence
  Synthetic oligonucleotide
ggtgagtttctggattgtct

SEQ ID NO: 553 - DNA, 20 bp, Artificial sequence
  Synthetic oligonucleotide
gctttgatattttagtgtct

SEQ ID NO: 554 - DNA, 20 bp, Artificial sequence
  Synthetic oligonucleotide
tgagctgtattattatgcca

SEQ ID NO: 555 - DNA, 20 bp, Artificial sequence
  Synthetic oligonucleotide
tccagatatgagttctctct

SEQ ID NO: 556 - DNA, 20 bp, Artificial sequence
  Synthetic oligonucleotide
gttcagactcagatctcttc

SEQ ID NO: 557 - DNA, 20 bp, Artificial sequence
  Synthetic oligonucleotide
atagtctttaatttttttct

SEQ ID NO: 558 - DNA, 20 bp, Artificial sequence
  Synthetic oligonucleotide
gtggaagtgtttcagggttg

SEQ ID NO: 559 - DNA, 20 bp, Artificial sequence
  Synthetic oligonucleotide
tgttgtttaaatatgtctcc

SEQ ID NO: 560 - DNA, 20 bp, Artificial sequence
  Synthetic oligonucleotide
gtgtggttataagagatctg

SEQ ID NO: 561 - DNA, 20 bp, Artificial sequence
  Synthetic oligonucleotide
cagtgctttctccagggtgt

SEQ ID NO: 562 - DNA, 20 bp, Artificial sequence
  Synthetic oligonucleotide
tcctctttataccagggatc

SEQ ID NO: 563 - DNA, 20 bp, Artificial sequence
  Synthetic oligonucleotide
atctccataaatggtatccc

SEQ ID NO: 564 - DNA, 20 bp, Artificial sequence
  Synthetic oligonucleotide
ggagagagagaatatttgag

SEQ ID NO: 565 - DNA, 20 bp, Artificial sequence
  Synthetic oligonucleotide
tgcggtttgcttattcttgc

SEQ ID NO: 566 - DNA, 20 bp, Artificial sequence
  Synthetic oligonucleotide
acttgagtacattcatatgg

SEQ ID NO: 567 - DNA, 20 bp, Artificial sequence
  Synthetic oligonucleotide
atctagattgaagtttgtac

SEQ ID NO: 568 - DNA, 20 bp, Artificial sequence
  Synthetic oligonucleotide
tgaggctcttctctttgggt

SEQ ID NO: 569 - DNA, 20 bp, Artificial sequence
  Synthetic oligonucleotide
attgctgtacaaggatgaca

SEQ ID NO: 570 - DNA, 20 bp, Artificial sequence
  Synthetic oligonucleotide
gcaggctgaaatccactctt

SEQ ID NO: 571 - DNA, 20 bp, Artificial sequence
  Synthetic oligonucleotide
tgttctttcttcctttcaca

SEQ ID NO: 572 - DNA, 20 bp, Artificial sequence
  Synthetic oligonucleotide
cggtgactgtttcactgtct

SEQ ID NO: 573 - DNA, 20 bp, Artificial sequence
  Synthetic oligonucleotide
cggtggttgtcgctgggcag

SEQ ID NO: 574 - DNA, 20 bp, Artificial sequence
  Synthetic oligonucleotide
agctttcttggtggcctccc

SEQ ID NO: 575 - DNA, 20 bp, Artificial sequence
  Synthetic oligonucleotide
gcttccctaaatgcaggcca

SEQ ID NO: 576 - DNA, 20 bp, Artificial sequence
  Synthetic oligonucleotide
tcttccaccttctttagctc

SEQ ID NO: 577 - DNA, 20 bp, Artificial sequence
  Synthetic oligonucleotide
gtcttcaatcctctctacgg

SEQ ID NO: 578 - DNA, 20 bp, Artificial sequence
  Synthetic oligonucleotide
ctcggcatacctgtgtctgc

SEQ ID NO: 579 - DNA, 20 bp, Artificial sequence
  Synthetic oligonucleotide
gtcttctgacttctccagtt

SEQ ID NO: 580 - DNA, 20 bp, Artificial sequence
  Synthetic oligonucleotide
gctcctgctgtgcccttcct

SEQ ID NO: 581 - DNA, 20 bp, Artificial sequence
  Synthetic oligonucleotide
atacaattaaaagttgcttt

SEQ ID NO: 582 - DNA, 20 bp, Artificial sequence
  Synthetic oligonucleotide
acccgagttgtccatagtca

SEQ ID NO: 583 - DNA, 20 bp, Artificial sequence
  Synthetic oligonucleotide
ctttcaatatcttgctcttc

SEQ ID NO: 584 - DNA, 20 bp, Artificial sequence
  Synthetic oligonucleotide
cttttctctcagtttctctg

SEQ ID NO: 585 - DNA, 20 bp, Artificial sequence
  Synthetic oligonucleotide
gctcacatatataaatgtct

SEQ ID NO: 586 - DNA, 20 bp, Artificial sequence
  Synthetic oligonucleotide
tttttttttaatttgtgaaa

SEQ ID NO: 587 - DNA, 20 bp, Artificial sequence
  Synthetic oligonucleotide
gtgtgtttttctgagtccac

SEQ ID NO: 588 - DNA, 20 bp, Artificial sequence
  Synthetic oligonucleotide
atcttagtgttggtttagtg

SEQ ID NO: 589 - DNA, 20 bp, Artificial sequence
  Synthetic oligonucleotide
tgagctttaactatatagca

SEQ ID NO: 590 - DNA, 20 bp, Artificial sequence
  Synthetic oligonucleotide
tggctgatccttgtaagctg

SEQ ID NO: 591 - DNA, 20 bp, Artificial sequence
  Synthetic oligonucleotide
tgttggtttcttattaatag

SEQ ID NO: 592 - DNA, 20 bp, Artificial sequence
  Synthetic oligonucleotide
tcttaagttaaacattctaa

SEQ ID NO: 593 - DNA, 20 bp, Artificial sequence
  Synthetic oligonucleotide
ataggtttccttagtagtca

SEQ ID NO: 594 - DNA, 20 bp, Artificial sequence
  Synthetic oligonucleotide
tctgctggccctgttttcac

SEQ ID NO: 595 - DNA, 20 bp, Artificial sequence
  Synthetic oligonucleotide
tccggagtagaggtgtgcaa

SEQ ID NO: 596 - DNA, 20 bp, Artificial sequence
  Synthetic oligonucleotide
gtgagtgcttcaaaattttg

SEQ ID NO: 597 - DNA, 20 bp, Artificial sequence
  Synthetic oligonucleotide
gtatagtttaagagcctttt

SEQ ID NO: 598 - DNA, 20 bp, Artificial sequence
  Synthetic oligonucleotide
cattgaaatcatgtttttac

SEQ ID NO: 599 - DNA, 20 bp, Artificial sequence
  Synthetic oligonucleotide
cccacagctgtccagtttcc

SEQ ID NO: 600 - DNA, 20 bp, Artificial sequence
  Synthetic oligonucleotide
acttggtattctggaggaca

SEQ ID NO: 601 - DNA, 20 bp, Artificial sequence
  Synthetic oligonucleotide
gggtaatgatctgatattaa

SEQ ID NO: 602 - DNA, 20 bp, Artificial sequence
  Synthetic oligonucleotide
atgcacttaaaattttcttt

SEQ ID NO: 603 - DNA, 20 bp, Artificial sequence
  Synthetic oligonucleotide
tcttccattttttaatattt

SEQ ID NO: 604 - DNA, 20 bp, Artificial sequence
  Synthetic oligonucleotide
tggcactgttattttattag

SEQ ID NO: 605 - DNA, 20 bp, Artificial sequence
  Synthetic oligonucleotide
tgctcattaaataattgcag

SEQ ID NO: 606 - DNA, 20 bp, Artificial sequence
  Synthetic oligonucleotide
gtgtcactagaagatgccca

SEQ ID NO: 607 - DNA, 20 bp, Artificial sequence
  Synthetic oligonucleotide
gtgctcactaataatagtct

SEQ ID NO: 608 - DNA, 20 bp, Artificial sequence
  Synthetic oligonucleotide
tctcctctacttaagctcag

SEQ ID NO: 609 - DNA, 20 bp, Artificial sequence
  Synthetic oligonucleotide
gtttcctatcctgattccca

SEQ ID NO: 610 - DNA, 20 bp, Artificial sequence
  Synthetic oligonucleotide
gtttgtgtgtttagttgttt

SEQ ID NO: 611 - DNA, 20 bp, Artificial sequence
  Synthetic oligonucleotide
gtgaccactctcctcctccc

SEQ ID NO: 612 - DNA, 20 bp, Artificial sequence
  Synthetic oligonucleotide
aaggttttctcttaaatatt

SEQ ID NO: 613 - DNA, 20 bp, Artificial sequence
  Synthetic oligonucleotide
tccgaagctgctatatgtca

SEQ ID NO: 614 - DNA, 20 bp, Artificial sequence
  Synthetic oligonucleotide
gtgtgacactattattcttt

SEQ ID NO: 615 - DNA, 20 bp, Artificial sequence
  Synthetic oligonucleotide
cgacctttaaaattttttca

SEQ ID NO: 616 - DNA, 20 bp, Artificial sequence
  Synthetic oligonucleotide
atttgtttacttctatattg

SEQ ID NO: 617 - DNA, 20 bp, Artificial sequence
  Synthetic oligonucleotide
gcttctttaaatcttagctc

SEQ ID NO: 618 - DNA, 20 bp, Artificial sequence
  Synthetic oligonucleotide
gtttgagtccagtgacttct

SEQ ID NO: 619 - DNA, 20 bp, Artificial sequence
  Synthetic oligonucleotide
tcttgagtttatcttttctt

SEQ ID NO: 620 - DNA, 20 bp, Artificial sequence
  Synthetic oligonucleotide
ctccagtgcagggctggact

SEQ ID NO: 621 - DNA, 20 bp, Artificial sequence
  Synthetic oligonucleotide
gtttgggtttttctgtacaa

SEQ ID NO: 622 - DNA, 20 bp, Artificial sequence
  Synthetic oligonucleotide
tggtaggtatatagatgtcc

SEQ ID NO: 623 - DNA, 20 bp, Artificial sequence
  Synthetic oligonucleotide
atcccaataaaaacattcag

SEQ ID NO: 624 - DNA, 20 bp, Artificial sequence
  Synthetic oligonucleotide
tgttccatagctcatttgca

SEQ ID NO: 625 - DNA, 20 bp, Artificial sequence
  Synthetic oligonucleotide
tgctgtgtacttaattgaca

SEQ ID NO: 626 - DNA, 20 bp, Artificial sequence
  Synthetic oligonucleotide
tcttgtctagttttctgcag

SEQ ID NO: 627 - DNA, 20 bp, Artificial sequence
  Synthetic oligonucleotide
gtcatttttgaacatatcct

SEQ ID NO: 628 - DNA, 20 bp, Artificial sequence
  Synthetic oligonucleotide
gtctgtgtacctcattcttt

SEQ ID NO: 629 - DNA, 20 bp, Artificial sequence
  Synthetic oligonucleotide
gtgtgggtggctgtgtcctg

SEQ ID NO: 630 - DNA, 20 bp, Artificial sequence
  Synthetic oligonucleotide
tggtgagtttctggattgtc

SEQ ID NO: 631 - DNA, 20 bp, Artificial sequence
  Synthetic oligonucleotide
cttttattttctgatgcttt

SEQ ID NO: 632 - DNA, 20 bp, Artificial sequence
  Synthetic oligonucleotide
gtagttcattttctttctcc

SEQ ID NO: 633 - DNA, 20 bp, Artificial sequence
  Synthetic oligonucleotide
aagtccagatatgagttctc

SEQ ID NO: 634 - DNA, 20 bp, Artificial sequence
  Synthetic oligonucleotide
atgttcagactcagatctct

SEQ ID NO: 635 - DNA, 20 bp, Artificial sequence
  Synthetic oligonucleotide
aatagtctttaatttttttc

SEQ ID NO: 636 - DNA, 20 bp, Artificial sequence
  Synthetic oligonucleotide
tccttggtggaagtgtttca

SEQ ID NO: 637 - DNA, 20 bp, Artificial sequence
  Synthetic oligonucleotide
ctgttgtttaaatatgtctc

SEQ ID NO: 638 - DNA, 20 bp, Artificial sequence
  Synthetic oligonucleotide
tcctccactctttccctccc

SEQ ID NO: 639 - DNA, 20 bp, Artificial sequence
  Synthetic oligonucleotide
gtttgccttctgtatggaaa

SEQ ID NO: 640 - DNA, 20 bp, Artificial sequence
  Synthetic oligonucleotide
tggagccttgctatgttggc

SEQ ID NO: 641 - DNA, 20 bp, Artificial sequence
  Synthetic oligonucleotide
tggttaagacctagtttctt

SEQ ID NO: 642 - DNA, 20 bp, Artificial sequence
  Synthetic oligonucleotide
atttcttgagatggattctc

SEQ ID NO: 643 - DNA, 20 bp, Artificial sequence
  Synthetic oligonucleotide
tctaccagagttgcggtttg

SEQ ID NO: 644 - DNA, 20 bp, Artificial sequence
  Synthetic oligonucleotide
cttcatcttctttgtttcct

SEQ ID NO: 645 - DNA, 20 bp, Artificial sequence
  Synthetic oligonucleotide
cattcttttgagttgtgacc

SEQ ID NO: 646 - DNA, 20 bp, Artificial sequence
  Synthetic oligonucleotide
gtttgattttatgcacacac

SEQ ID NO: 647 - DNA, 20 bp, Artificial sequence
  Synthetic oligonucleotide
agaccaaaaaccatttgtgt

SEQ ID NO: 648 - DNA, 20 bp, Artificial sequence
  Synthetic oligonucleotide
actctggatgaaatcttctg

SEQ ID NO: 649 - DNA, 20 bp, Artificial sequence
  Synthetic oligonucleotide
gctgggttctattttggtga

SEQ ID NO: 650 - DNA, 20 bp, Artificial sequence
  Synthetic oligonucleotide
ttttattgtaaaatatgttg

SEQ ID NO: 651 - DNA, 20 bp, Artificial sequence
  Synthetic oligonucleotide
gatagtaatatatgctcatc

SEQ ID NO: 652 - DNA, 20 bp, Artificial sequence
  Synthetic oligonucleotide
ttggtggtcatttattgtca

SEQ ID NO: 653 - DNA, 20 bp, Artificial sequence
  Synthetic oligonucleotide
atcttgctcacatatataaa

SEQ ID NO: 654 - DNA, 20 bp, Artificial sequence
  Synthetic oligonucleotide
ctagacagccaaaatgtggg

SEQ ID NO: 655 - DNA, 20 bp, Artificial sequence
  Synthetic oligonucleotide
ccagtcaattcaatactcga

SEQ ID NO: 656 - DNA, 20 bp, Artificial sequence
  Synthetic oligonucleotide
ctccacattcactattccgt

SEQ ID NO: 657 - DNA, 20 bp, Artificial sequence
  Synthetic oligonucleotide
ttcttaagttaaacattcta

SEQ ID NO: 658 - DNA, 20 bp, Artificial sequence
  Synthetic oligonucleotide
ggagtaatccacaagatgca

SEQ ID NO: 659 - DNA, 20 bp, Artificial sequence
  Synthetic oligonucleotide
tcctttcacatcaccaccga

SEQ ID NO: 660 - DNA, 20 bp, Artificial sequence
  Synthetic oligonucleotide
atgtaaaagaaatctcagct

SEQ ID NO: 661 - DNA, 20 bp, Artificial sequence
  Synthetic oligonucleotide
acatgacaaatttctatata

SEQ ID NO: 662 - DNA, 20 bp, Artificial sequence
  Synthetic oligonucleotide
gtttttactccccccattta

SEQ ID NO: 663 - DNA, 20 bp, Artificial sequence
  Synthetic oligonucleotide
tgcacttaattttaatacag

SEQ ID NO: 664 - DNA, 20 bp, Artificial sequence
  Synthetic oligonucleotide
gggcagtattcacagaactg

SEQ ID NO: 665 - DNA, 20 bp, Artificial sequence
  Synthetic oligonucleotide
tcttaactattatgtatgca

SEQ ID NO: 666 - DNA, 20 bp, Artificial sequence
  Synthetic oligonucleotide
tcaaattttgaatcaaacat

SEQ ID NO: 667 - DNA, 20 bp, Artificial sequence
  Synthetic oligonucleotide
tgagtgcacatttaatcttt

SEQ ID NO: 668 - DNA, 20 bp, Artificial sequence
  Synthetic oligonucleotide
ttgtcatatttttatagcat

SEQ ID NO: 669 - DNA, 20 bp, Artificial sequence
  Synthetic oligonucleotide
tgttcattcccttagtaact

SEQ ID NO: 670 - DNA, 20 bp, Artificial sequence
  Synthetic oligonucleotide
ggcaagatcttttaaagtcc

SEQ ID NO: 671 - DNA, 20 bp, Artificial sequence
  Synthetic oligonucleotide
agactgtttctttaccacat

SEQ ID NO: 672 - DNA, 20 bp, Artificial sequence
  Synthetic oligonucleotide
tccaccagtatttatggagt

SEQ ID NO: 673 - DNA, 20 bp, Artificial sequence
  Synthetic oligonucleotide
ctttagtatttttatcatta

SEQ ID NO: 674 - DNA, 20 bp, Artificial sequence
  Synthetic oligonucleotide
aacagtacaatttacttgac

SEQ ID NO: 675 - DNA, 20 bp, Artificial sequence
  Synthetic oligonucleotide
cctttaaaaaccaacacagt

SEQ ID NO: 676 - DNA, 20 bp, Artificial sequence
  Synthetic oligonucleotide
tcttgtcatttttaacatcc

SEQ ID NO: 677 - DNA, 20 bp, Artificial sequence
  Synthetic oligonucleotide
actcaattttaaagactcgg

SEQ ID NO: 678 - DNA, 20 bp, Artificial sequence
  Synthetic oligonucleotide
atgtgttgaatttaaccagc

SEQ ID NO: 679 - DNA, 20 bp, Artificial sequence
  Synthetic oligonucleotide
ctcattaattaaatcattcg

SEQ ID NO: 680 - DNA, 20 bp, Artificial sequence
  Synthetic oligonucleotide
cacctaaaaatacaggaagt

SEQ ID NO: 681 - DNA, 20 bp, Artificial sequence
  Synthetic oligonucleotide
ccaagaatttaaaaaggaca

SEQ ID NO: 682 - DNA, 20 bp, Artificial sequence
  Synthetic oligonucleotide
tgtctcaaactattcccatt

SEQ ID NO: 683 - DNA, 20 bp, Artificial sequence
  Synthetic oligonucleotide
ttaacaatcttttagacctg

SEQ ID NO: 684 - DNA, 20 bp, Artificial sequence
  Synthetic oligonucleotide
gacatatttcaaaaatgcaa

SEQ ID NO: 685 - DNA, 20 bp, Artificial sequence
  Synthetic oligonucleotide
aacttgtttcaaagtgagag

SEQ ID NO: 686 - DNA, 20 bp, Artificial sequence
  Synthetic oligonucleotide
tcagggttcctcatcttaat

SEQ ID NO: 687 - DNA, 20 bp, Artificial sequence
  Synthetic oligonucleotide
agagagtataaaaattatct

SEQ ID NO: 688 - DNA, 20 bp, Artificial sequence
  Synthetic oligonucleotide
gcagcctcctatattggtcc

SEQ ID NO: 689 - DNA, 20 bp, Artificial sequence
  Synthetic oligonucleotide
ccagtgactcatcttggcta

SEQ ID NO: 690 - DNA, 20 bp, Artificial sequence
  Synthetic oligonucleotide
tggtcctttcctcacttggg

SEQ ID NO: 691 - DNA, 20 bp, Artificial sequence
  Synthetic oligonucleotide
catgtttattttccatgtgt

SEQ ID NO: 692 - DNA, 20 bp, Artificial sequence
  Synthetic oligonucleotide
acacacctagatcttcctcc

SEQ ID NO: 693 - DNA, 20 bp, Artificial sequence
  Synthetic oligonucleotide
cagcagtgcctaaccagttg

SEQ ID NO: 694 - DNA, 20 bp, Artificial sequence
  Synthetic oligonucleotide
tgccagagacccaaatccgc

SEQ ID NO: 695 - DNA, 20 bp, Artificial sequence
  Synthetic oligonucleotide
tcatccccaaactaaacacc

SEQ ID NO: 696 - DNA, 20 bp, Artificial sequence
  Synthetic oligonucleotide
gctaacctacttcctaccca

SEQ ID NO: 697 - DNA, 20 bp, Artificial sequence
  Synthetic oligonucleotide
catgacatcatttagcctta

SEQ ID NO: 698 - DNA, 20 bp, Artificial sequence
  Synthetic oligonucleotide
ggccctaataacacagagcc

SEQ ID NO: 699 - DNA, 20 bp, Artificial sequence
  Synthetic oligonucleotide
gcggcacaaatccagggctg

SEQ ID NO: 700 - DNA, 20 bp, Artificial sequence
  Synthetic oligonucleotide
gtagtataaactatggactt

SEQ ID NO: 701 - DNA, 20 bp, Artificial sequence
  Synthetic oligonucleotide
agggttgttcagtaaaccca

SEQ ID NO: 702 - DNA, 20 bp, Artificial sequence
  Synthetic oligonucleotide
gctaggtttcagtaagtatg

SEQ ID NO: 703 - DNA, 20 bp, Artificial sequence
  Synthetic oligonucleotide
acacgcatatttatgctgtt

SEQ ID NO: 704 - DNA, 20 bp, Artificial sequence
  Synthetic oligonucleotide
acctccaactcccattttgg

SEQ ID NO: 705 - DNA, 20 bp, Artificial sequence
  Synthetic oligonucleotide
gtaaatatatcctgtttcaa

SEQ ID NO: 706 - DNA, 20 bp, Artificial sequence
  Synthetic oligonucleotide
tcaccttgtcagatgctgag

SEQ ID NO: 707 - DNA, 20 bp, Artificial sequence
  Synthetic oligonucleotide
ggtgagcaaccattccagac

SEQ ID NO: 708 - DNA, 20 bp, Artificial sequence
  Synthetic oligonucleotide
ctcggtcaccacatgcaagc

SEQ ID NO: 709 - DNA, 20 bp, Artificial sequence
  Synthetic oligonucleotide
gacctaaaacacaccagacc

SEQ ID NO: 710 - DNA, 20 bp, Artificial sequence
  Synthetic oligonucleotide
atagcttcaaaatattgtta

SEQ ID NO: 711 - DNA, 20 bp, Artificial sequence
  Synthetic oligonucleotide
atctttattttataattagg

SEQ ID NO: 712 - DNA, 20 bp, Artificial sequence
  Synthetic oligonucleotide
gatgccacgaccagatatca

SEQ ID NO: 713 - DNA, 20 bp, Artificial sequence
  Synthetic oligonucleotide
accaaactccaaatctccaa

SEQ ID NO: 714 - DNA, 20 bp, Artificial sequence
  Synthetic oligonucleotide
tcaaccttcttgaaccctca

SEQ ID NO: 715 - DNA, 20 bp, Artificial sequence
  Synthetic oligonucleotide
tcattatttccgcatctcaa

SEQ ID NO: 716 - DNA, 20 bp, Artificial sequence
  Synthetic oligonucleotide
ccggacacctacccatggag

SEQ ID NO: 717 - DNA, 20 bp, Artificial sequence
  Synthetic oligonucleotide
cactgtattctaagtaggag

SEQ ID NO: 718 - DNA, 20 bp, Artificial sequence
  Synthetic oligonucleotide
gcctcctgacctctaccctt

SEQ ID NO: 719 - DNA, 20 bp, Artificial sequence
  Synthetic oligonucleotide
agtagatttccacagattgt

SEQ ID NO: 720 - DNA, 20 bp, Artificial sequence
  Synthetic oligonucleotide
agcctctagaacaaaataca

SEQ ID NO: 721 - DNA, 20 bp, Artificial sequence
  Synthetic oligonucleotide
agcttgagaattttgatagg

SEQ ID NO: 722 - DNA, 20 bp, Artificial sequence
  Synthetic oligonucleotide
gaaccacaagccaacaggcc

SEQ ID NO: 723 - DNA, 20 bp, Artificial sequence
  Synthetic oligonucleotide
actgtgagttccaagaagca

SEQ ID NO: 724 - DNA, 20 bp, Artificial sequence
  Synthetic oligonucleotide
tgggtacaatccgccaacag

SEQ ID NO: 725 - DNA, 20 bp, Artificial sequence
  Synthetic oligonucleotide
tgtcttcaatcctctctacg

SEQ ID NO: 726 - DNA, 20 bp, Artificial sequence
  Synthetic oligonucleotide
aggaagagtcaaaggtggtt

SEQ ID NO: 727 - DNA, 20 bp, Artificial sequence
  Synthetic oligonucleotide
gttgcttttattgtaaaata

SEQ ID NO: 728 - DNA, 20 bp, Artificial sequence
  Synthetic oligonucleotide
aagatagtaatatatgctca

SEQ ID NO: 729 - DNA, 20 bp, Artificial sequence
  Synthetic oligonucleotide
catcaaagtgaaaagtgcct

SEQ ID NO: 730 - DNA, 20 bp, Artificial sequence
  Synthetic oligonucleotide
ccattctgaaaataacatta

SEQ ID NO: 731 - DNA, 20 bp, Artificial sequence
  Synthetic oligonucleotide
ggtgaaccctaaatgtaaat

SEQ ID NO: 732 - DNA, 20 bp, Artificial sequence
  Synthetic oligonucleotide
tccagtcaattcaatactcg

SEQ ID NO: 733 - DNA, 20 bp, Artificial sequence
  Synthetic oligonucleotide
acactccacattcactattc

SEQ ID NO: 734 - DNA, 20 bp, Artificial sequence
  Synthetic oligonucleotide
actgaaataattcttaagtt

SEQ ID NO: 735 - DNA, 20 bp, Artificial sequence
  Synthetic oligonucleotide
agcattatattgcaatctat

SEQ ID NO: 736 - DNA, 20 bp, Artificial sequence
  Synthetic oligonucleotide
tctcctttcacatcaccacc

SEQ ID NO: 737 - DNA, 20 bp, Artificial sequence
  Synthetic oligonucleotide
gaggtcatctatgtaaaaga

SEQ ID NO: 738 - DNA, 20 bp, Artificial sequence
  Synthetic oligonucleotide
gacatgacaaatttctatat

SEQ ID NO: 739 - DNA, 20 bp, Artificial sequence
  Synthetic oligonucleotide
atcatgtttttactcccccc

SEQ ID NO: 740 - DNA, 20 bp, Artificial sequence
  Synthetic oligonucleotide
cctattggccaaatgcactt

SEQ ID NO: 741 - DNA, 20 bp, Artificial sequence
  Synthetic oligonucleotide
tcttgaaacctcctttcggc

SEQ ID NO: 742 - DNA, 20 bp, Artificial sequence
  Synthetic oligonucleotide
ctcttaactattatgtatgc

SEQ ID NO: 743 - DNA, 20 bp, Artificial sequence
  Synthetic oligonucleotide
gttcaaattttgaatcaaac

SEQ ID NO: 744 - DNA, 20 bp, Artificial sequence
  Synthetic oligonucleotide
cccaaatttcaaaggtcctt

SEQ ID NO: 745 - DNA, 20 bp, Artificial sequence
  Synthetic oligonucleotide
gtggtcaaagaatctgtttc

SEQ ID NO: 746 - DNA, 20 bp, Artificial sequence
  Synthetic oligonucleotide
tagaaactaatttattagtg

SEQ ID NO: 747 - DNA, 20 bp, Artificial sequence
  Synthetic oligonucleotide
acacagattatttatagtca

SEQ ID NO: 748 - DNA, 20 bp, Artificial sequence
  Synthetic oligonucleotide
cactttctagattattctta

SEQ ID NO: 749 - DNA, 20 bp, Artificial sequence
  Synthetic oligonucleotide
actctctacctttaagattt

SEQ ID NO: 750 - DNA, 20 bp, Artificial sequence
  Synthetic oligonucleotide
catctatttatttaccttct

SEQ ID NO: 751 - DNA, 20 bp, Artificial sequence
  Synthetic oligonucleotide
gaacttaaaattccctagga

SEQ ID NO: 752 - DNA, 20 bp, Artificial sequence
  Synthetic oligonucleotide
tcttttaacctttaaaaacc

SEQ ID NO: 753 - DNA, 20 bp, Artificial sequence
  Synthetic oligonucleotide
acctgctttcaaaagtcaaa

SEQ ID NO: 754 - DNA, 20 bp, Artificial sequence
  Synthetic oligonucleotide
caagtaatacaaatccacag

SEQ ID NO: 755 - DNA, 20 bp, Artificial sequence
  Synthetic oligonucleotide
caggacttattttatatatg

SEQ ID NO: 756 - DNA, 20 bp, Artificial sequence
  Synthetic oligonucleotide
cttcccaaatacatcatcga

SEQ ID NO: 757 - DNA, 20 bp, Artificial sequence
  Synthetic oligonucleotide
catttaaaaactgtacatgg

SEQ ID NO: 758 - DNA, 20 bp, Artificial sequence
  Synthetic oligonucleotide
atctaaatttaaactgcaca

SEQ ID NO: 759 - DNA, 20 bp, Artificial sequence
  Synthetic oligonucleotide
tggtcaataatttatatggc

SEQ ID NO: 760 - DNA, 20 bp, Artificial sequence
  Synthetic oligonucleotide
aactattatatttatagatt

SEQ ID NO: 761 - DNA, 20 bp, Artificial sequence
  Synthetic oligonucleotide
agctgtaaaatatatccctg

SEQ ID NO: 762 - DNA, 20 bp, Artificial sequence
  Synthetic oligonucleotide
aaccttacttaaatatctca

SEQ ID NO: 763 - DNA, 20 bp, Artificial sequence
  Synthetic oligonucleotide
atcagggttcctcatcttaa

SEQ ID NO: 764 - DNA, 20 bp, Artificial sequence
  Synthetic oligonucleotide
gtgccctttcctcttgggat

SEQ ID NO: 765 - DNA, 20 bp, Artificial sequence
  Synthetic oligonucleotide
cccagcagcctcctatattg

SEQ ID NO: 766 - DNA, 20 bp, Artificial sequence
  Synthetic oligonucleotide
acttccagtgactcatcttg

SEQ ID NO: 767 - DNA, 20 bp, Artificial sequence
  Synthetic oligonucleotide
atttggtcctttcctcactt

SEQ ID NO: 768 - DNA, 20 bp, Artificial sequence
  Synthetic oligonucleotide
ctcatgtttattttccatgt

SEQ ID NO: 769 - DNA, 20 bp, Artificial sequence
  Synthetic oligonucleotide
agggaaaaacacacctagat

SEQ ID NO: 770 - DNA, 20 bp, Artificial sequence
  Synthetic oligonucleotide
gtcagcagtgcctaaccagt

SEQ ID NO: 771 - DNA, 20 bp, Artificial sequence
  Synthetic oligonucleotide
acagaaaaacaaaactcatt

SEQ ID NO: 772 - DNA, 20 bp, Artificial sequence
  Synthetic oligonucleotide
ccttaaaaatcatccccaaa

SEQ ID NO: 773 - DNA, 20 bp, Artificial sequence
  Synthetic oligonucleotide
cagctaacctacttcctacc

SEQ ID NO: 774 - DNA, 20 bp, Artificial sequence
  Synthetic oligonucleotide
tcagaaatacagattgatat

SEQ ID NO: 775 - DNA, 20 bp, Artificial sequence
  Synthetic oligonucleotide
acggccctaataacacagag

SEQ ID NO: 776 - DNA, 20 bp, Artificial sequence
  Synthetic oligonucleotide
actgcggcacaaatccaggg

SEQ ID NO: 777 - DNA, 20 bp, Artificial sequence
  Synthetic oligonucleotide
tgtagtataaactatggact

SEQ ID NO: 778 - DNA, 20 bp, Artificial sequence
  Synthetic oligonucleotide
gaagtgtttcagggttgttc

SEQ ID NO: 779 - DNA, 20 bp, Artificial sequence
  Synthetic oligonucleotide
agctaggtttcagtaagtat

SEQ ID NO: 780 - DNA, 20 bp, Artificial sequence
  Synthetic oligonucleotide
tacacgcatatttatgctgt

SEQ ID NO: 781 - DNA, 20 bp, Artificial sequence
  Synthetic oligonucleotide
aactgtcacctccaactccc

SEQ ID NO: 782 - DNA, 20 bp, Artificial sequence
  Synthetic oligonucleotide
ccagtaaatatatcctgttt

SEQ ID NO: 783 - DNA, 20 bp, Artificial sequence
  Synthetic oligonucleotide
catagccacctcaccttgtc

SEQ ID NO: 784 - DNA, 20 bp, Artificial sequence
  Synthetic oligonucleotide
gcaacagaccagtagcagtc

SEQ ID NO: 785 - DNA, 20 bp, Artificial sequence
  Synthetic oligonucleotide
tacctccaccacctttgtcc

SEQ ID NO: 786 - DNA, 20 bp, Artificial sequence
  Synthetic oligonucleotide
gtgacctaaaacacaccaga

SEQ ID NO: 787 - DNA, 20 bp, Artificial sequence
  Synthetic oligonucleotide
gatagcttcaaaatattgtt

SEQ ID NO: 788 - DNA, 20 bp, Artificial sequence
  Synthetic oligonucleotide
gcaaatctatctttatttta

SEQ ID NO: 789 - DNA, 20 bp, Artificial sequence
  Synthetic oligonucleotide
cctgcgaaaagatgccacga

SEQ ID NO: 790 - DNA, 20 bp, Artificial sequence
  Synthetic oligonucleotide
aagttcagttacagaggtgc

SEQ ID NO: 791 - DNA, 20 bp, Artificial sequence
  Synthetic oligonucleotide
gttctcaaccttcttgaacc

SEQ ID NO: 792 - DNA, 20 bp, Artificial sequence
  Synthetic oligonucleotide
ctttcattatttccgcatct

SEQ ID NO: 793 - DNA, 20 bp, Artificial sequence
  Synthetic oligonucleotide
gccggacacctacccatgga

SEQ ID NO: 794 - DNA, 20 bp, Artificial sequence
  Synthetic oligonucleotide
cccactgtattctaagtagg

SEQ ID NO: 795 - DNA, 20 bp, Artificial sequence
  Synthetic oligonucleotide
tttttctgtgcctcctgacc

SEQ ID NO: 796 - DNA, 20 bp, Artificial sequence
  Synthetic oligonucleotide
aagtaccaaaaaaactttaa

SEQ ID NO: 797 - DNA, 20 bp, Artificial sequence
  Synthetic oligonucleotide
agcctctagaacaggctggg

SEQ ID NO: 798 - DNA, 20 bp, Artificial sequence
  Synthetic oligonucleotide
acagcttgagaattttgata

SEQ ID NO: 799 - DNA, 20 bp, Artificial sequence
  Synthetic oligonucleotide
acagtgaaccacaagccaac

SEQ ID NO: 800 - DNA, 20 bp, Artificial sequence
  Synthetic oligonucleotide
acaggactaaacatggatca

SEQ ID NO: 801 - DNA, 20 bp, Artificial sequence
  Synthetic oligonucleotide
atccaggctcttcatgagga

SEQ ID NO: 802 - DNA, 20 bp, Artificial sequence
  Synthetic oligonucleotide
tatggctgtcttcaatcctc

SEQ ID NO: 803 - DNA, 20 bp, Artificial sequence
  Synthetic oligonucleotide
caaatcttaacctcctgagg

SEQ ID NO: 804 - DNA, 20 bp, Artificial sequence
  Synthetic oligonucleotide
tatacaattaaaagttgctt

SEQ ID NO: 805 - DNA, 20 bp, Artificial sequence
  Synthetic oligonucleotide
cagtatttttaaatgcttaa

SEQ ID NO: 806 - DNA, 20 bp, Artificial sequence
  Synthetic oligonucleotide
actgattctcagacatcaaa

SEQ ID NO: 807 - DNA, 20 bp, Artificial sequence
  Synthetic oligonucleotide
gccattctgaaaataacatt

SEQ ID NO: 808 - DNA, 20 bp, Artificial sequence
  Synthetic oligonucleotide
ctggtgaaccctaaatgtaa

SEQ ID NO: 809 - DNA, 20 bp, Artificial sequence
  Synthetic oligonucleotide
atccagtcaattcaatactc

SEQ ID NO: 810 - DNA, 20 bp, Artificial sequence
  Synthetic oligonucleotide
ccacactccacattcactat

SEQ ID NO: 811 - DNA, 20 bp, Artificial sequence
  Synthetic oligonucleotide
cccctctgccccagtgtggc

SEQ ID NO: 812 - DNA, 20 bp, Artificial sequence
  Synthetic oligonucleotide
tgcagcattatattgcaatc

SEQ ID NO: 813 - DNA, 20 bp, Artificial sequence
  Synthetic oligonucleotide
ctctcctttcacatcaccac

SEQ ID NO: 814 - DNA, 20 bp, Artificial sequence
  Synthetic oligonucleotide
tcctatcatcagtaaggtaa

SEQ ID NO: 815 - DNA, 20 bp, Artificial sequence
  Synthetic oligonucleotide
aatctgatcatttagacatg

SEQ ID NO: 816 - DNA, 20 bp, Artificial sequence
  Synthetic oligonucleotide
aatcatgtttttactccccc

SEQ ID NO: 817 - DNA, 20 bp, Artificial sequence
  Synthetic oligonucleotide
atagatactacctattggcc

SEQ ID NO: 818 - DNA, 20 bp, Artificial sequence
  Synthetic oligonucleotide
atcttgaaacctcctttcgg

SEQ ID NO: 819 - DNA, 20 bp, Artificial sequence
  Synthetic oligonucleotide
agctcttaactattatgtat

SEQ ID NO: 820 - DNA, 20 bp, Artificial sequence
  Synthetic oligonucleotide
gtatacagacaatttattta

SEQ ID NO: 821 - DNA, 20 bp, Artificial sequence
  Synthetic oligonucleotide
acatggtatttttatcagtc

SEQ ID NO: 822 - DNA, 20 bp, Artificial sequence
  Synthetic oligonucleotide
cctaacaaaatttcccttca

SEQ ID NO: 823 - DNA, 20 bp, Artificial sequence
  Synthetic oligonucleotide
gtgaattttccttaaatttc

SEQ ID NO: 824 - DNA, 20 bp, Artificial sequence
  Synthetic oligonucleotide
tgcaaattctaaaaattact

SEQ ID NO: 825 - DNA, 20 bp, Artificial sequence
  Synthetic oligonucleotide
ttcttgtttcaaagtgagga

SEQ ID NO: 826 - DNA, 20 bp, Artificial sequence
  Synthetic oligonucleotide
gacctcatccattataatat

SEQ ID NO: 827 - DNA, 20 bp, Artificial sequence
  Synthetic oligonucleotide
ccaaccaaccaaaaactcac

SEQ ID NO: 828 - DNA, 20 bp, Artificial sequence
  Synthetic oligonucleotide
catagttatatttaatcatg

SEQ ID NO: 829 - DNA, 20 bp, Artificial sequence
  Synthetic oligonucleotide
atgcctcacctttaaatagt

SEQ ID NO: 830 - DNA, 20 bp, Artificial sequence
  Synthetic oligonucleotide
gacaagtttatttatttttc

SEQ ID NO: 831 - DNA, 20 bp, Artificial sequence
  Synthetic oligonucleotide
aactgatttcaaagtcagac

SEQ ID NO: 832 - DNA, 20 bp, Artificial sequence
  Synthetic oligonucleotide
actgaaactttttaacatac

SEQ ID NO: 833 - DNA, 20 bp, Artificial sequence
  Synthetic oligonucleotide
cagcaaatacaaacaggacc

SEQ ID NO: 834 - DNA, 20 bp, Artificial sequence
  Synthetic oligonucleotide
acacagttacaaatcaatgc

SEQ ID NO: 835 - DNA, 20 bp, Artificial sequence
  Synthetic oligonucleotide
tggatctaaatttaaactgc

SEQ ID NO: 836 - DNA, 20 bp, Artificial sequence
  Synthetic oligonucleotide
atgctcaaacctcattcatt

SEQ ID NO: 837 - DNA, 20 bp, Artificial sequence
  Synthetic oligonucleotide
tactccttattttaaatata

SEQ ID NO: 838 - DNA, 20 bp, Artificial sequence
  Synthetic oligonucleotide
aaggttctattttatatgcc

SEQ ID NO: 839 - DNA, 20 bp, Artificial sequence
  Synthetic oligonucleotide
agtgttagagaatacttttc

SEQ ID NO: 840 - DNA, 20 bp, Artificial sequence
  Synthetic oligonucleotide
aatcagggttcctcatctta

SEQ ID NO: 841 - DNA, 20 bp, Artificial sequence
  Synthetic oligonucleotide
tgccccccactttacggtgt

SEQ ID NO: 842 - DNA, 20 bp, Artificial sequence
  Synthetic oligonucleotide
cagtccagagcccactcccc

SEQ ID NO: 843 - DNA, 20 bp, Artificial sequence
  Synthetic oligonucleotide
aaccatacttccagtgactc

SEQ ID NO: 844 - DNA, 20 bp, Artificial sequence
  Synthetic oligonucleotide
ccagtcattcacgagtggtt

SEQ ID NO: 845 - DNA, 20 bp, Artificial sequence
  Synthetic oligonucleotide
tgactcttcactcatgttta

SEQ ID NO: 846 - DNA, 20 bp, Artificial sequence
  Synthetic oligonucleotide
gtagggaaaaacacacctag

SEQ ID NO: 847 - DNA, 20 bp, Artificial sequence
  Synthetic oligonucleotide
catttctgaatttctctgtg

SEQ ID NO: 848 - DNA, 20 bp, Artificial sequence
  Synthetic oligonucleotide
ccacagaaaaacaaaactca

SEQ ID NO: 849 - DNA, 20 bp, Artificial sequence
  Synthetic oligonucleotide
cccttaaaaatcatccccaa

SEQ ID NO: 850 - DNA, 20 bp, Artificial sequence
  Synthetic oligonucleotide
gcagctaacctacttcctac

SEQ ID NO: 851 - DNA, 20 bp, Artificial sequence
  Synthetic oligonucleotide
tactcagaaatacagattga

SEQ ID NO: 852 - DNA, 20 bp, Artificial sequence
  Synthetic oligonucleotide
acagacggccctaataacac

SEQ ID NO: 853 - DNA, 20 bp, Artificial sequence
  Synthetic oligonucleotide
tgtattaccaacaactgcgg

SEQ ID NO: 854 - DNA, 20 bp, Artificial sequence
  Synthetic oligonucleotide
acagagtgaactgtagtata

SEQ ID NO: 855 - DNA, 20 bp, Artificial sequence
  Synthetic oligonucleotide
agcctgactcagtccttggt

SEQ ID NO: 856 - DNA, 20 bp, Artificial sequence
  Synthetic oligonucleotide
gaattctctcataagctagg

SEQ ID NO: 857 - DNA, 20 bp, Artificial sequence
  Synthetic oligonucleotide
atgcacatacacgcatattt

SEQ ID NO: 858 - DNA, 20 bp, Artificial sequence
  Synthetic oligonucleotide
ccatccccctaaatcgactc

SEQ ID NO: 859 - DNA, 20 bp, Artificial sequence
  Synthetic oligonucleotide
atccagtaaatatatcctgt

SEQ ID NO: 860 - DNA, 20 bp, Artificial sequence
  Synthetic oligonucleotide
ggcagctttctcagcggagc

SEQ ID NO: 861 - DNA, 20 bp, Artificial sequence
  Synthetic oligonucleotide
atccccaacccccaggcaac

SEQ ID NO: 862 - DNA, 20 bp, Artificial sequence
  Synthetic oligonucleotide
actacctccaccacctttgt

SEQ ID NO: 863 - DNA, 20 bp, Artificial sequence
  Synthetic oligonucleotide
aagtgacctaaaacacacca

SEQ ID NO: 864 - DNA, 20 bp, Artificial sequence
  Synthetic oligonucleotide
tgatagcttcaaaatattgt

SEQ ID NO: 865 - DNA, 20 bp, Artificial sequence
  Synthetic oligonucleotide
tagcaaatctatctttattt

SEQ ID NO: 866 - DNA, 20 bp, Artificial sequence
  Synthetic oligonucleotide
aggagctgtgtcaccctgcg

SEQ ID NO: 867 - DNA, 20 bp, Artificial sequence
  Synthetic oligonucleotide
cagccaaacctaagttcagt

SEQ ID NO: 868 - DNA, 20 bp, Artificial sequence
  Synthetic oligonucleotide
agttctcaaccttcttgaac

SEQ ID NO: 869 - DNA, 20 bp, Artificial sequence
  Synthetic oligonucleotide
aaagcctttcattatttccg

SEQ ID NO: 870 - DNA, 20 bp, Artificial sequence
  Synthetic oligonucleotide
ccggataactccctgtctcc

SEQ ID NO: 871 - DNA, 20 bp, Artificial sequence
  Synthetic oligonucleotide
acccactgtattctaagtag

SEQ ID NO: 872 - DNA, 20 bp, Artificial sequence
  Synthetic oligonucleotide
aacccattttcttttttctg

SEQ ID NO: 873 - DNA, 20 bp, Artificial sequence
  Synthetic oligonucleotide
gattttatacacattcagac

SEQ ID NO: 874 - DNA, 20 bp, Artificial sequence
  Synthetic oligonucleotide
catcttgtaaactaaacagg

SEQ ID NO: 875 - DNA, 20 bp, Artificial sequence
  Synthetic oligonucleotide
gcttacaataattaagaaga

SEQ ID NO: 876 - DNA, 20 bp, Artificial sequence
  Synthetic oligonucleotide
agacagtgaaccacaagcca

SEQ ID NO: 877 - DNA, 20 bp, Artificial sequence
  Synthetic oligonucleotide
ggacaggactaaacatggat

SEQ ID NO: 878 - DNA, 20 bp, Artificial sequence
  Synthetic oligonucleotide
agtctgataaacggaaagtc

SEQ ID NO: 879 - DNA, 20 bp, Artificial sequence
  Synthetic oligonucleotide
tatcacggccacgcccgggc

SEQ ID NO: 880 - DNA, 20 bp, Artificial sequence
  Synthetic oligonucleotide
atgcaaatcttaacctcctg

SEQ ID NO: 881 - DNA, 20 bp, Artificial sequence
  Synthetic oligonucleotide
ctatacaattaaaagttgct

SEQ ID NO: 882 - DNA, 20 bp, Artificial sequence
  Synthetic oligonucleotide
acagtatttttaaatgctta

SEQ ID NO: 883 - DNA, 20 bp, Artificial sequence
  Synthetic oligonucleotide
aactgattctcagacatcaa

SEQ ID NO: 884 - DNA, 20 bp, Artificial sequence
  Synthetic oligonucleotide
gatttgattttgaatagaaa

SEQ ID NO: 885 - DNA, 20 bp, Artificial sequence
  Synthetic oligonucleotide
cctggtgaaccctaaatgta

SEQ ID NO: 886 - DNA, 20 bp, Artificial sequence
  Synthetic oligonucleotide
tagtggatccagtcaattca

SEQ ID NO: 887 - DNA, 20 bp, Artificial sequence
  Synthetic oligonucleotide
tctccacactccacattcac

SEQ ID NO: 888 - DNA, 20 bp, Artificial sequence
  Synthetic oligonucleotide
cactttaaaagatctgaggt

SEQ ID NO: 889 - DNA, 20 bp, Artificial sequence
  Synthetic oligonucleotide
gctactgttcatcttgaaca

SEQ ID NO: 890 - DNA, 20 bp, Artificial sequence
  Synthetic oligonucleotide
agtgtaattctctcctttca

SEQ ID NO: 891 - DNA, 20 bp, Artificial sequence
  Synthetic oligonucleotide
aagaaaagatcctatcatca

SEQ ID NO: 892 - DNA, 20 bp, Artificial sequence
  Synthetic oligonucleotide
atacaaatctgatcatttag

SEQ ID NO: 893 - DNA, 20 bp, Artificial sequence
  Synthetic oligonucleotide
aaatcatgtttttactcccc

SEQ ID NO: 894 - DNA, 20 bp, Artificial sequence
  Synthetic oligonucleotide
gtatagatactacctattgg

SEQ ID NO: 895 - DNA, 20 bp, Artificial sequence
  Synthetic oligonucleotide
ccacaaatactgacaggact

SEQ ID NO: 896 - DNA, 20 bp, Artificial sequence
  Synthetic oligonucleotide
aagctcttaactattatgta

SEQ ID NO: 897 - DNA, 20 bp, Artificial sequence
  Synthetic oligonucleotide
tggtatacagacaatttatt

SEQ ID NO: 898 - DNA, 20 bp, Artificial sequence
  Synthetic oligonucleotide
aactttaaaaccaaagagcc

SEQ ID NO: 899 - DNA, 20 bp, Artificial sequence
  Synthetic oligonucleotide
tgtacaataatatatttctt

SEQ ID NO: 900 - DNA, 20 bp, Artificial sequence
  Synthetic oligonucleotide
gcagaaattcattaaaaagg

SEQ ID NO: 901 - DNA, 20 bp, Artificial sequence
  Synthetic oligonucleotide
tactggtatatttatttgtt

SEQ ID NO: 902 - DNA, 20 bp, Artificial sequence
  Synthetic oligonucleotide
cttgagtttcattatctcct

SEQ ID NO: 903 - DNA, 20 bp, Artificial sequence
  Synthetic oligonucleotide
catacattcccttaagccaa

SEQ ID NO: 904 - DNA, 20 bp, Artificial sequence
  Synthetic oligonucleotide
agtattatttaaaactacat

SEQ ID NO: 905 - DNA, 20 bp, Artificial sequence
  Synthetic oligonucleotide
ccatggtttcaaagctctgt

SEQ ID NO: 906 - DNA, 20 bp, Artificial sequence
  Synthetic oligonucleotide
agctataaaatataaacttc

SEQ ID NO: 907 - DNA, 20 bp, Artificial sequence
  Synthetic oligonucleotide
agcttttgaatttattatga

SEQ ID NO: 908 - DNA, 20 bp, Artificial sequence
  Synthetic oligonucleotide
cagagactattttaaagacg

SEQ ID NO: 909 - DNA, 20 bp, Artificial sequence
  Synthetic oligonucleotide
ctcttattttaaactggtgc

SEQ ID NO: 910 - DNA, 20 bp, Artificial sequence
  Synthetic oligonucleotide
ttactgattatttaaccctg

SEQ ID NO: 911 - DNA, 20 bp, Artificial sequence
  Synthetic oligonucleotide
agttcattttaaactgtatt

SEQ ID NO: 912 - DNA, 20 bp, Artificial sequence
  Synthetic oligonucleotide
tgtattattttctaacagaa

SEQ ID NO: 913 - DNA, 20 bp, Artificial sequence
  Synthetic oligonucleotide
aagtatacaatttaaggatc

SEQ ID NO: 914 - DNA, 20 bp, Artificial sequence
  Synthetic oligonucleotide
attagatttccttactgcaa

SEQ ID NO: 915 - DNA, 20 bp, Artificial sequence
  Synthetic oligonucleotide
cctctcaaaaccacttttat

SEQ ID NO: 916 - DNA, 20 bp, Artificial sequence
  Synthetic oligonucleotide
ccctcaattcaaagacaaat

SEQ ID NO: 917 - DNA, 20 bp, Artificial sequence
  Synthetic oligonucleotide
tttcctaatcagggttcctc

SEQ ID NO: 918 - DNA, 20 bp, Artificial sequence
  Synthetic oligonucleotide
gtgccccccactttacggtg

SEQ ID NO: 919 - DNA, 20 bp, Artificial sequence
  Synthetic oligonucleotide
cctgactttcatatgcaaac

SEQ ID NO: 920 - DNA, 20 bp, Artificial sequence
  Synthetic oligonucleotide
ttaaccatacttccagtgac

SEQ ID NO: 921 - DNA, 20 bp, Artificial sequence
  Synthetic oligonucleotide
ccccatatccagtcattcac

SEQ ID NO: 922 - DNA, 20 bp, Artificial sequence
  Synthetic oligonucleotide
gcaatgactcttcactcatg

SEQ ID NO: 923 - DNA, 20 bp, Artificial sequence
  Synthetic oligonucleotide
gagtagggaaaaacacacct

SEQ ID NO: 924 - DNA, 20 bp, Artificial sequence
  Synthetic oligonucleotide
aagctcaacaatttgcacat

SEQ ID NO: 925 - DNA, 20 bp, Artificial sequence
  Synthetic oligonucleotide
acgaacacaaaaacccacag

SEQ ID NO: 926 - DNA, 20 bp, Artificial sequence
  Synthetic oligonucleotide
ccccttaaaaatcatcccca

SEQ ID NO: 927 - DNA, 20 bp, Artificial sequence
  Synthetic oligonucleotide
agcagctaacctacttccta

SEQ ID NO: 928 - DNA, 20 bp, Artificial sequence
  Synthetic oligonucleotide
tcatactcagaaatacagat

SEQ ID NO: 929 - DNA, 20 bp, Artificial sequence
  Synthetic oligonucleotide
ttaagcagccaccgagtcag

SEQ ID NO: 930 - DNA, 20 bp, Artificial sequence
  Synthetic oligonucleotide
gtgtattaccaacaactgcg

SEQ ID NO: 931 - DNA, 20 bp, Artificial sequence
  Synthetic oligonucleotide
ttcatcaaaaacagcatgta

SEQ ID NO: 932 - DNA, 20 bp, Artificial sequence
  Synthetic oligonucleotide
cacgcaaagcctgactcagt

SEQ ID NO: 933 - DNA, 20 bp, Artificial sequence
  Synthetic oligonucleotide
tgaattctctcataagctag

SEQ ID NO: 934 - DNA, 20 bp, Artificial sequence
  Synthetic oligonucleotide
actatgcacatacacgcata

SEQ ID NO: 935 - DNA, 20 bp, Artificial sequence
  Synthetic oligonucleotide
atccatccccctaaatcgac

SEQ ID NO: 936 - DNA, 20 bp, Artificial sequence
  Synthetic oligonucleotide
catccagtaaatatatcctg

SEQ ID NO: 937 - DNA, 20 bp, Artificial sequence
  Synthetic oligonucleotide
ctttaccgcctaacaggcag

SEQ ID NO: 938 - DNA, 20 bp, Artificial sequence
  Synthetic oligonucleotide
gatccccaacccccaggcaa

SEQ ID NO: 939 - DNA, 20 bp, Artificial sequence
  Synthetic oligonucleotide
ttttactacctccaccacct

SEQ ID NO: 940 - DNA, 20 bp, Artificial sequence
  Synthetic oligonucleotide
actcaaacttaaagtgacct

SEQ ID NO: 941 - DNA, 20 bp, Artificial sequence
  Synthetic oligonucleotide
tgggtattctctatgatgct

SEQ ID NO: 942 - DNA, 20 bp, Artificial sequence
  Synthetic oligonucleotide
tcatagcaaatctatcttta

SEQ ID NO: 943 - DNA, 20 bp, Artificial sequence
  Synthetic oligonucleotide
gcttcctaccaaaggagctg

SEQ ID NO: 944 - DNA, 20 bp, Artificial sequence
  Synthetic oligonucleotide
gcagccaaacctaagttcag

SEQ ID NO: 945 - DNA, 20 bp, Artificial sequence
  Synthetic oligonucleotide
aagaagttctcaaccttctt

SEQ ID NO: 946 - DNA, 20 bp, Artificial sequence
  Synthetic oligonucleotide
gaaagcctttcattatttcc

SEQ ID NO: 947 - DNA, 20 bp, Artificial sequence
  Synthetic oligonucleotide
tagttccaaacatgtcagcc

SEQ ID NO: 948 - DNA, 20 bp, Artificial sequence
  Synthetic oligonucleotide
gacaaatatacttacaagtg

SEQ ID NO: 949 - DNA, 20 bp, Artificial sequence
  Synthetic oligonucleotide
cccccaaacccattttcttt

SEQ ID NO: 950 - DNA, 20 bp, Artificial sequence
  Synthetic oligonucleotide
ttggattttatacacattca

SEQ ID NO: 951 - DNA, 20 bp, Artificial sequence
  Synthetic oligonucleotide
gctataaatcaaagacatct

SEQ ID NO: 952 - DNA, 20 bp, Artificial sequence
  Synthetic oligonucleotide
tgcttacaataattaagaag

SEQ ID NO: 953 - DNA, 20 bp, Artificial sequence
  Synthetic oligonucleotide
ttgtgaccccaaagcactgt

SEQ ID NO: 954 - DNA, 20 bp, Artificial sequence
  Synthetic oligonucleotide
gctattatcatacaggacag

SEQ ID NO: 955 - DNA, 20 bp, Artificial sequence
  Synthetic oligonucleotide
gattttagtctgataaacgg

SEQ ID NO: 956 - DNA, 20 bp, Artificial sequence
  Synthetic oligonucleotide
cgacggcgaactgtatcacg

SEQ ID NO: 957 - DNA, 20 bp, Artificial sequence
  Synthetic oligonucleotide
tagaccggccttcaatgcaa

SEQ ID NO: 958 - DNA, 20 bp, Artificial sequence
  Synthetic oligonucleotide
atctatacaattaaaagttg

SEQ ID NO: 959 - DNA, 20 bp, Artificial sequence
  Synthetic oligonucleotide
gaacagtatttttaaatgct

SEQ ID NO: 960 - DNA, 20 bp, Artificial sequence
  Synthetic oligonucleotide
gaactgattctcagacatca

SEQ ID NO: 961 - DNA, 20 bp, Artificial sequence
  Synthetic oligonucleotide
accaaacattaaatctcgat

SEQ ID NO: 962 - DNA, 20 bp, Artificial sequence
  Synthetic oligonucleotide
gtttataaaaatcattagtc

SEQ ID NO: 963 - DNA, 20 bp, Artificial sequence
  Synthetic oligonucleotide
gctccaaaccatgtgtgttt

SEQ ID NO: 964 - DNA, 20 bp, Artificial sequence
  Synthetic oligonucleotide
gcctccttcctctccacact

SEQ ID NO: 965 - DNA, 20 bp, Artificial sequence
  Synthetic oligonucleotide
ttccactttaaaagatctga

SEQ ID NO: 966 - DNA, 20 bp, Artificial sequence
  Synthetic oligonucleotide
ggattttatgattactagga

SEQ ID NO: 967 - DNA, 20 bp, Artificial sequence
  Synthetic oligonucleotide
ggcctccacgccacttaaaa

SEQ ID NO: 968 - DNA, 20 bp, Artificial sequence
  Synthetic oligonucleotide
tgctacaagaaaagatccta

SEQ ID NO: 969 - DNA, 20 bp, Artificial sequence
  Synthetic oligonucleotide
ataaccatacaaatctgatc

SEQ ID NO: 970 - DNA, 20 bp, Artificial sequence
  Synthetic oligonucleotide
ttacattgaaatcatgtttt

SEQ ID NO: 971 - DNA, 20 bp, Artificial sequence
  Synthetic oligonucleotide
tgtatagatactacctattg

SEQ ID NO: 972 - DNA, 20 bp, Artificial sequence
  Synthetic oligonucleotide
ggtcaccacaaatactgaca

SEQ ID NO: 973 - DNA, 20 bp, Artificial sequence
  Synthetic oligonucleotide
tgtcacaataaaagctctta

SEQ ID NO: 974 - DNA, 20 bp, Artificial sequence
  Synthetic oligonucleotide
actggtatacagacaattta

SEQ ID NO: 975 - DNA, 20 bp, Artificial sequence
  Synthetic oligonucleotide
cccagcaaagccatccagtg

SEQ ID NO: 976 - DNA, 20 bp, Artificial sequence
  Synthetic oligonucleotide
ttgattacaatttaaattca

SEQ ID NO: 977 - DNA, 20 bp, Artificial sequence
  Synthetic oligonucleotide
aagggaatattttactttat

SEQ ID NO: 978 - DNA, 20 bp, Artificial sequence
  Synthetic oligonucleotide
ctattattattttactggca

SEQ ID NO: 979 - DNA, 20 bp, Artificial sequence
  Synthetic oligonucleotide
ttttatagccactaaccaac

SEQ ID NO: 980 - DNA, 20 bp, Artificial sequence
  Synthetic oligonucleotide
aacatatttcattataattc

SEQ ID NO: 981 - DNA, 20 bp, Artificial sequence
  Synthetic oligonucleotide
acccagcatttttaacatta

SEQ ID NO: 982 - DNA, 20 bp, Artificial sequence
  Synthetic oligonucleotide
ctttcatttatttagtgaaa

SEQ ID NO: 983 - DNA, 20 bp, Artificial sequence
  Synthetic oligonucleotide
ttccttactttttaggatac

SEQ ID NO: 984 - DNA, 20 bp, Artificial sequence
  Synthetic oligonucleotide
gatttattttaaagtactct

SEQ ID NO: 985 - DNA, 20 bp, Artificial sequence
  Synthetic oligonucleotide
gattccaaaaccagacttgt

SEQ ID NO: 986 - DNA, 20 bp, Artificial sequence
  Synthetic oligonucleotide
ccatatatagattacaaagc

SEQ ID NO: 987 - DNA, 20 bp, Artificial sequence
  Synthetic oligonucleotide
tcttttaaccctaagactgt

SEQ ID NO: 988 - DNA, 20 bp, Artificial sequence
  Synthetic oligonucleotide
tgacagtatttttaaagact

SEQ ID NO: 989 - DNA, 20 bp, Artificial sequence
  Synthetic oligonucleotide
actggcaaacccaaaagcta

SEQ ID NO: 990 - DNA, 20 bp, Artificial sequence
  Synthetic oligonucleotide
actgttaaaacccatccaac

SEQ ID NO: 991 - DNA, 20 bp, Artificial sequence
  Synthetic oligonucleotide
atgcagttctaaaagaaagc

SEQ ID NO: 992 - DNA, 20 bp, Artificial sequence
  Synthetic oligonucleotide
aggcccaaacctctaatcaa

SEQ ID NO: 993 - DNA, 20 bp, Artificial sequence
  Synthetic oligonucleotide
aagattcaaatatatcttaa

SEQ ID NO: 994 - DNA, 20 bp, Artificial sequence
  Synthetic oligonucleotide
ggacctgaagtccagcagcg

SEQ ID NO: 995 - DNA, 20 bp, Artificial sequence
  Synthetic oligonucleotide
actccctccacctcctgacc

SEQ ID NO: 996 - DNA, 20 bp, Artificial sequence
  Synthetic oligonucleotide
gcctgactttcatatgcaaa

SEQ ID NO: 997 - DNA, 20 bp, Artificial sequence
  Synthetic oligonucleotide
gcctgtggaaattaagagcg

SEQ ID NO: 998 - DNA, 20 bp, Artificial sequence
  Synthetic oligonucleotide
tgcaagcccccatatccagt

SEQ ID NO: 999 - DNA, 20 bp, Artificial sequence
  Synthetic oligonucleotide
ttaaggattctaagtaccat

SEQ ID NO: 1000 - DNA, 20 bp, Artificial sequence
  Synthetic oligonucleotide
tcattaattttgcaaagttt

SEQ ID NO: 1001 - DNA, 20 bp, Artificial sequence
  Synthetic oligonucleotide
ttttgcttattaagctcaac

SEQ ID NO: 1002 - DNA, 20 bp, Artificial sequence
  Synthetic oligonucleotide
aacgaacacaaaaacccaca

SEQ ID NO: 1003 - DNA, 20 bp, Artificial sequence
  Synthetic oligonucleotide
agccccttaaaaatcatccc

SEQ ID NO: 1004 - DNA, 20 bp, Artificial sequence
  Synthetic oligonucleotide
aagcagctaacctacttcct

SEQ ID NO: 1005 - DNA, 20 bp, Artificial sequence
  Synthetic oligonucleotide
gttcatactcagaaatacag

SEQ ID NO: 1006 - DNA, 20 bp, Artificial sequence
  Synthetic oligonucleotide
cactgaatattaagcagcca

SEQ ID NO: 1007 - DNA, 20 bp, Artificial sequence
  Synthetic oligonucleotide
tgtgtattaccaacaactgc

SEQ ID NO: 1008 - DNA, 20 bp, Artificial sequence
  Synthetic oligonucleotide
acatgacatcataaattcat

SEQ ID NO: 1009 - DNA, 20 bp, Artificial sequence
  Synthetic oligonucleotide
aatcatgttcacgcaaagcc

SEQ ID NO: 1010 - DNA, 20 bp, Artificial sequence
  Synthetic oligonucleotide
aatgaattctctcataagct

SEQ ID NO: 1011 - DNA, 20 bp, Artificial sequence
  Synthetic oligonucleotide
ctatatctaaacactatgca

SEQ ID NO: 1012 - DNA, 20 bp, Artificial sequence
  Synthetic oligonucleotide
catccatccccctaaatcga

SEQ ID NO: 1013 - DNA, 20 bp, Artificial sequence
  Synthetic oligonucleotide
tcatccagtaaatatatcct

SEQ ID NO: 1014 - DNA, 20 bp, Artificial sequence
  Synthetic oligonucleotide
gctttaccgcctaacaggca

SEQ ID NO: 1015 - DNA, 20 bp, Artificial sequence
  Synthetic oligonucleotide
cctctttataccagggatcc

SEQ ID NO: 1016 - DNA, 20 bp, Artificial sequence
  Synthetic oligonucleotide
tttttactacctccaccacc

SEQ ID NO: 1017 - DNA, 20 bp, Artificial sequence
  Synthetic oligonucleotide
gcaactcaaacttaaagtga

SEQ ID NO: 1018 - DNA, 20 bp, Artificial sequence
  Synthetic oligonucleotide
atgggtattctctatgatgc

SEQ ID NO: 1019 - DNA, 20 bp, Artificial sequence
  Synthetic oligonucleotide
attcatagcaaatctatctt

SEQ ID NO: 1020 - DNA, 20 bp, Artificial sequence
  Synthetic oligonucleotide
tgcttcctaccaaaggagct

SEQ ID NO: 1021 - DNA, 20 bp, Artificial sequence
  Synthetic oligonucleotide
agcagccaaacctaagttca

SEQ ID NO: 1022 - DNA, 20 bp, Artificial sequence
  Synthetic oligonucleotide
accctctattaaaaatacta

SEQ ID NO: 1023 - DNA, 20 bp, Artificial sequence
  Synthetic oligonucleotide
tttgaaagcctttcattatt

SEQ ID NO: 1024 - DNA, 20 bp, Artificial sequence
  Synthetic oligonucleotide
ccttagttccaaacatgtca

SEQ ID NO: 1025 - DNA, 20 bp, Artificial sequence
  Synthetic oligonucleotide
acatagacaaatatacttac

SEQ ID NO: 1026 - DNA, 20 bp, Artificial sequence
  Synthetic oligonucleotide
gcccccaaacccattttctt

SEQ ID NO: 1027 - DNA, 20 bp, Artificial sequence
  Synthetic oligonucleotide
atgcaccaccaccaccacgc

SEQ ID NO: 1028 - DNA, 20 bp, Artificial sequence
  Synthetic oligonucleotide
tgctataaatcaaagacatc

SEQ ID NO: 1029 - DNA, 20 bp, Artificial sequence
  Synthetic oligonucleotide
ttacaaagactatgcttaca

SEQ ID NO: 1030 - DNA, 20 bp, Artificial sequence
  Synthetic oligonucleotide
agttgtgaccccaaagcact

SEQ ID NO: 1031 - DNA, 20 bp, Artificial sequence
  Synthetic oligonucleotide
tgctattatcatacaggaca

SEQ ID NO: 1032 - DNA, 20 bp, Artificial sequence
  Synthetic oligonucleotide
tggctctgattttagtctga

SEQ ID NO: 1033 - DNA, 20 bp, Artificial sequence
  Synthetic oligonucleotide
tactctaccaaaacttcaac

SEQ ID NO: 1034 - DNA, 20 bp, Artificial sequence
  Synthetic oligonucleotide
ttagaccggccttcaatgca

SEQ ID NO: 1035 - DNA, 20 bp, Artificial sequence
  Synthetic oligonucleotide
gcagaaatgaaatcccgcat

SEQ ID NO: 1036 - DNA, 20 bp, Artificial sequence
  Synthetic oligonucleotide
tgagatacagtacttgttga

SEQ ID NO: 1037 - DNA, 20 bp, Artificial sequence
  Synthetic oligonucleotide
ttctccatcccttttctctc

SEQ ID NO: 1038 - DNA, 20 bp, Artificial sequence
  Synthetic oligonucleotide
gtaccaaacattaaatctcg

SEQ ID NO: 1039 - DNA, 20 bp, Artificial sequence
  Synthetic oligonucleotide
cggtttataaaaatcattag

SEQ ID NO: 1040 - DNA, 20 bp, Artificial sequence
  Synthetic oligonucleotide
tgctccaaaccatgtgtgtt

SEQ ID NO: 1041 - DNA, 20 bp, Artificial sequence
  Synthetic oligonucleotide
tgaatctgcctccttcctct

SEQ ID NO: 1042 - DNA, 20 bp, Artificial sequence
  Synthetic oligonucleotide
tttccactttaaaagatctg

SEQ ID NO: 1043 - DNA, 20 bp, Artificial sequence
  Synthetic oligonucleotide
agtggattttatgattacta

SEQ ID NO: 1044 - DNA, 20 bp, Artificial sequence
  Synthetic oligonucleotide
ggttaaaaacaaatgtggaa

SEQ ID NO: 1045 - DNA, 20 bp, Artificial sequence
  Synthetic oligonucleotide
gcttctcaaatcaggtgtac

SEQ ID NO: 1046 - DNA, 20 bp, Artificial sequence
  Synthetic oligonucleotide
ggccataaccatacaaatct

SEQ ID NO: 1047 - DNA, 20 bp, Artificial sequence
  Synthetic oligonucleotide
ggcctctttatattaaataa

SEQ ID NO: 1048 - DNA, 20 bp, Artificial sequence
  Synthetic oligonucleotide
tcagataagaaaagttatgg

SEQ ID NO: 1049 - DNA, 20 bp, Artificial sequence
  Synthetic oligonucleotide
aggtcaccacaaatactgac

SEQ ID NO: 1050 - DNA, 20 bp, Artificial sequence
  Synthetic oligonucleotide
ttctcctgtcacaataaaag

SEQ ID NO: 1051 - DNA, 20 bp, Artificial sequence
  Synthetic oligonucleotide
gtactggtatacagacaatt

SEQ ID NO: 1052 - DNA, 20 bp, Artificial sequence
  Synthetic oligonucleotide
gtcctcaaaacctatggagc

SEQ ID NO: 1053 - DNA, 20 bp, Artificial sequence
  Synthetic oligonucleotide
tggcttaaccagggagatgt

SEQ ID NO: 1054 - DNA, 20 bp, Artificial sequence
  Synthetic oligonucleotide
actgataatttttagacata

SEQ ID NO: 1055 - DNA, 20 bp, Artificial sequence
  Synthetic oligonucleotide
acctcaatcatttactctct

SEQ ID NO: 1056 - DNA, 20 bp, Artificial sequence
  Synthetic oligonucleotide
actcctaaaatttattgagg

SEQ ID NO: 1057 - DNA, 20 bp, Artificial sequence
  Synthetic oligonucleotide
ccctgaatagtctatgccat

SEQ ID NO: 1058 - DNA, 20 bp, Artificial sequence
  Synthetic oligonucleotide
ttccttaaaatatgttggca

SEQ ID NO: 1059 - DNA, 20 bp, Artificial sequence
  Synthetic oligonucleotide
ggaaacaaccaaaaactgct

SEQ ID NO: 1060 - DNA, 20 bp, Artificial sequence
  Synthetic oligonucleotide
tgacacaatatttactgtgt

SEQ ID NO: 1061 - DNA, 20 bp, Artificial sequence
  Synthetic oligonucleotide
tctcagtttcaaaataggac

SEQ ID NO: 1062 - DNA, 20 bp, Artificial sequence
  Synthetic oligonucleotide
cctcaaaaagaatctgcaga

SEQ ID NO: 1063 - DNA, 20 bp, Artificial sequence
  Synthetic oligonucleotide
tcggttactatttacctttc

SEQ ID NO: 1064 - DNA, 20 bp, Artificial sequence
  Synthetic oligonucleotide
ggaccctaaatttaaacagc

SEQ ID NO: 1065 - DNA, 20 bp, Artificial sequence
  Synthetic oligonucleotide
tggaaatttcaaaaagctaa

SEQ ID NO: 1066 - DNA, 20 bp, Artificial sequence
  Synthetic oligonucleotide
aacaacaaataattacctat

SEQ ID NO: 1067 - DNA, 20 bp, Artificial sequence
  Synthetic oligonucleotide
aaggaaaatcaaacattgct

SEQ ID NO: 1068 - DNA, 20 bp, Artificial sequence
  Synthetic oligonucleotide
aggtctagtatttatcttct

SEQ ID NO: 1069 - DNA, 20 bp, Artificial sequence
  Synthetic oligonucleotide
gaaacattattttacttttc

SEQ ID NO: 1070 - DNA, 20 bp, Artificial sequence
  Synthetic oligonucleotide
tcctaaaaatacatcttaaa

SEQ ID NO: 1071 - DNA, 20 bp, Artificial sequence
  Synthetic oligonucleotide
ctggtaagaaaaagtgccga

SEQ ID NO: 1072 - DNA, 20 bp, Artificial sequence
  Synthetic oligonucleotide
gccacatttcccctcactcc

SEQ ID NO: 1073 - DNA, 20 bp, Artificial sequence
  Synthetic oligonucleotide
agcctgactttcatatgcaa

SEQ ID NO: 1074 - DNA, 20 bp, Artificial sequence
  Synthetic oligonucleotide
gtaatcgatctaagaacctg

SEQ ID NO: 1075 - DNA, 20 bp, Artificial sequence
  Synthetic oligonucleotide
tttgtgcaagcccccatatc

SEQ ID NO: 1076 - DNA, 20 bp, Artificial sequence
  Synthetic oligonucleotide
tgttcacaaaaatgtgttaa

SEQ ID NO: 1077 - DNA, 20 bp, Artificial sequence
  Synthetic oligonucleotide
catttaatcattaattttgc

SEQ ID NO: 1078 - DNA, 20 bp, Artificial sequence
  Synthetic oligonucleotide
attttgcttattaagctcaa

SEQ ID NO: 1079 - DNA, 20 bp, Artificial sequence
  Synthetic oligonucleotide
ccaatgatcccatcactgca

SEQ ID NO: 1080 - DNA, 20 bp, Artificial sequence
  Synthetic oligonucleotide
cagccccttaaaaatcatcc

SEQ ID NO: 1081 - DNA, 20 bp, Artificial sequence
  Synthetic oligonucleotide
tgccagttcctgcattttcc

SEQ ID NO: 1082 - DNA, 20 bp, Artificial sequence
  Synthetic oligonucleotide
cagttcatactcagaaatac

SEQ ID NO: 1083 - DNA, 20 bp, Artificial sequence
  Synthetic oligonucleotide
gcactgaatattaagcagcc

SEQ ID NO: 1084 - DNA, 20 bp, Artificial sequence
  Synthetic oligonucleotide
gtgtgtattaccaacaactg

SEQ ID NO: 1085 - DNA, 20 bp, Artificial sequence
  Synthetic oligonucleotide
tacatgacatcataaattca

SEQ ID NO: 1086 - DNA, 20 bp, Artificial sequence
  Synthetic oligonucleotide
acactgaatcatgttcacgc

SEQ ID NO: 1087 - DNA, 20 bp, Artificial sequence
  Synthetic oligonucleotide
gagcaatgaattctctcata

SEQ ID NO: 1088 - DNA, 20 bp, Artificial sequence
  Synthetic oligonucleotide
tactatatctaaacactatg

SEQ ID NO: 1089 - DNA, 20 bp, Artificial sequence
  Synthetic oligonucleotide
tcctccatccatccccctaa

SEQ ID NO: 1090 - DNA, 20 bp, Artificial sequence
  Synthetic oligonucleotide
cccattttttcatccagtaa

SEQ ID NO: 1091 - DNA, 20 bp, Artificial sequence
  Synthetic oligonucleotide
ggctttaccgcctaacaggc

SEQ ID NO: 1092 - DNA, 20 bp, Artificial sequence
  Synthetic oligonucleotide
ctcctctttataccagggat

SEQ ID NO: 1093 - DNA, 20 bp, Artificial sequence
  Synthetic oligonucleotide
ttttttactacctccaccac

SEQ ID NO: 1094 - DNA, 20 bp, Artificial sequence
  Synthetic oligonucleotide
tgggcaactcaaacttaaag

SEQ ID NO: 1095 - DNA, 20 bp, Artificial sequence
  Synthetic oligonucleotide
aatttaaaacccatatgggt

SEQ ID NO: 1096 - DNA, 20 bp, Artificial sequence
  Synthetic oligonucleotide
cacacatctcaaataggtac

SEQ ID NO: 1097 - DNA, 20 bp, Artificial sequence
  Synthetic oligonucleotide
gcctaaattctgcctttgct

SEQ ID NO: 1098 - DNA, 20 bp, Artificial sequence
  Synthetic oligonucleotide
gtgagcagccaaacctaagt

SEQ ID NO: 1099 - DNA, 20 bp, Artificial sequence
  Synthetic oligonucleotide
aaccctctattaaaaatact

SEQ ID NO: 1100 - DNA, 20 bp, Artificial sequence
  Synthetic oligonucleotide
ctaaagacttcataatgtta

SEQ ID NO: 1101 - DNA, 20 bp, Artificial sequence
  Synthetic oligonucleotide
agccttagttccaaacatgt

SEQ ID NO: 1102 - DNA, 20 bp, Artificial sequence
  Synthetic oligonucleotide
gtgcatatatacatagacaa

SEQ ID NO: 1103 - DNA, 20 bp, Artificial sequence
  Synthetic oligonucleotide
ggcccccaaacccattttct

SEQ ID NO: 1104 - DNA, 20 bp, Artificial sequence
  Synthetic oligonucleotide
aatatttaaaatattgttgg

SEQ ID NO: 1105 - DNA, 20 bp, Artificial sequence
  Synthetic oligonucleotide
ctgctataaatcaaagacat

SEQ ID NO: 1106 - DNA, 20 bp, Artificial sequence
  Synthetic oligonucleotide
tagactttacaaagactatg

SEQ ID NO: 1107 - DNA, 20 bp, Artificial sequence
  Synthetic oligonucleotide
ctggtgagccccattctttt

SEQ ID NO: 1108 - DNA, 20 bp, Artificial sequence
  Synthetic oligonucleotide
ctgctattatcatacaggac

SEQ ID NO: 1109 - DNA, 20 bp, Artificial sequence
  Synthetic oligonucleotide
gttggatttcatttttcgcc

SEQ ID NO: 1110 - DNA, 20 bp, Artificial sequence
  Synthetic oligonucleotide
atactctaccaaaacttcaa

SEQ ID NO: 1111 - DNA, 20 bp, Artificial sequence
  Synthetic oligonucleotide
ccacgctgcctctacttgcc

SEQ ID NO: 1112 - DNA, 20 bp, Artificial sequence
  Synthetic oligonucleotide
agcagaaatgaaatcccgca

SEQ ID NO: 1113 - DNA, 20 bp, Artificial sequence
  Synthetic oligonucleotide
agtgagatacagtacttgtt

SEQ ID NO: 1114 - DNA, 20 bp, Artificial sequence
  Synthetic oligonucleotide
actggacaaaaatgagtatt

SEQ ID NO: 1115 - DNA, 20 bp, Artificial sequence
  Synthetic oligonucleotide
tgtaccaaacattaaatctc

SEQ ID NO: 1116 - DNA, 20 bp, Artificial sequence
  Synthetic oligonucleotide
acggtttataaaaatcatta

SEQ ID NO: 1117 - DNA, 20 bp, Artificial sequence
  Synthetic oligonucleotide
ttgctccaaaccatgtgtgt

SEQ ID NO: 1118 - DNA, 20 bp, Artificial sequence
  Synthetic oligonucleotide
ccacacttcccgtccaggct

SEQ ID NO: 1119 - DNA, 20 bp, Artificial sequence
  Synthetic oligonucleotide
ccaacatagaaaattatcct

SEQ ID NO: 1120 - DNA, 20 bp, Artificial sequence
  Synthetic oligonucleotide
aagagtggattttatgatta

SEQ ID NO: 1121 - DNA, 20 bp, Artificial sequence
  Synthetic oligonucleotide
gggttaaaaacaaatgtgga

SEQ ID NO: 1122 - DNA, 20 bp, Artificial sequence
  Synthetic oligonucleotide
agcttctcaaatcaggtgta

SEQ ID NO: 1123 - DNA, 20 bp, Artificial sequence
  Synthetic oligonucleotide
cttccaggccataaccatac

SEQ ID NO: 1124 - DNA, 20 bp, Artificial sequence
  Synthetic oligonucleotide
ctggcctctttatattaaat

SEQ ID NO: 1125 - DNA, 20 bp, Artificial sequence
  Synthetic oligonucleotide
gagtcctttcagataagaaa

SEQ ID NO: 1126 - DNA, 20 bp, Artificial sequence
  Synthetic oligonucleotide
ctctggagccaggactccac

SEQ ID NO: 1127 - DNA, 20 bp, Artificial sequence
  Synthetic oligonucleotide
catatggaaaaaagttctcc

SEQ ID NO: 1128 - DNA, 20 bp, Artificial sequence
  Synthetic oligonucleotide
tgtactggtatacagacaat

SEQ ID NO: 1129 - DNA, 20 bp, Artificial sequence
  Synthetic oligonucleotide
ccaataaaagccacaacttg

SEQ ID NO: 1130 - DNA, 20 bp, Artificial sequence
  Synthetic oligonucleotide
aaggtgtatatttatatgtt

SEQ ID NO: 1131 - DNA, 20 bp, Artificial sequence
  Synthetic oligonucleotide
gctcaaattcaaaagatgaa

SEQ ID NO: 1132 - DNA, 20 bp, Artificial sequence
  Synthetic oligonucleotide
tcagtaaaacctcaatcatt

SEQ ID NO: 1133 - DNA, 20 bp, Artificial sequence
  Synthetic oligonucleotide
tggaatattctttattttgg

SEQ ID NO: 1134 - DNA, 20 bp, Artificial sequence
  Synthetic oligonucleotide
ttactctttcaaatgcaaaa

SEQ ID NO: 1135 - DNA, 20 bp, Artificial sequence
  Synthetic oligonucleotide
aggttctatatttagaacac

SEQ ID NO: 1136 - DNA, 20 bp, Artificial sequence
  Synthetic oligonucleotide
ctcacaattcaaaagttgtg

SEQ ID NO: 1137 - DNA, 20 bp, Artificial sequence
  Synthetic oligonucleotide
ttagtcaaacatatcaacct

SEQ ID NO: 1138 - DNA, 20 bp, Artificial sequence
  Synthetic oligonucleotide
ggctgcaaactattcaagta

SEQ ID NO: 1139 - DNA, 20 bp, Artificial sequence
  Synthetic oligonucleotide
tcattattagattaccaaga

SEQ ID NO: 1140 - DNA, 20 bp, Artificial sequence
  Synthetic oligonucleotide
cagtaatttcaaaagggcca

SEQ ID NO: 1141 - DNA, 20 bp, Artificial sequence
  Synthetic oligonucleotide
tggatgctattttatgtaga

SEQ ID NO: 1142 - DNA, 20 bp, Artificial sequence
  Synthetic oligonucleotide
gaccacaaaacccaacttac

SEQ ID NO: 1143 - DNA, 20 bp, Artificial sequence
  Synthetic oligonucleotide
tcaacaaatcaaatactgat

SEQ ID NO: 1144 - DNA, 20 bp, Artificial sequence
  Synthetic oligonucleotide
tgctgcatattttatattta

SEQ ID NO: 1145 - DNA, 20 bp, Artificial sequence
  Synthetic oligonucleotide
agtgtattagattaggtcta

SEQ ID NO: 1146 - DNA, 20 bp, Artificial sequence
  Synthetic oligonucleotide
ctccttaaaccccattttat

SEQ ID NO: 1147 - DNA, 20 bp, Artificial sequence
  Synthetic oligonucleotide
ctcctaaaaatacatcttaa

SEQ ID NO: 1148 - DNA, 20 bp, Artificial sequence
  Synthetic oligonucleotide
cctggtaagaaaaagtgccg

SEQ ID NO: 1149 - DNA, 20 bp, Artificial sequence
  Synthetic oligonucleotide
gtttgccacatttcccctca

SEQ ID NO: 1150 - DNA, 20 bp, Artificial sequence
  Synthetic oligonucleotide
cagagctaattcctaggagc

SEQ ID NO: 1151 - DNA, 20 bp, Artificial sequence
  Synthetic oligonucleotide
gcatgtaatcgatctaagaa

SEQ ID NO: 1152 - DNA, 20 bp, Artificial sequence
  Synthetic oligonucleotide
ttcagggctaaaagctctcg

SEQ ID NO: 1153 - DNA, 20 bp, Artificial sequence
  Synthetic oligonucleotide
ctgttcacaaaaatgtgtta

SEQ ID NO: 1154 - DNA, 20 bp, Artificial sequence
  Synthetic oligonucleotide
tcatttaatcattaattttg

SEQ ID NO: 1155 - DNA, 20 bp, Artificial sequence
  Synthetic oligonucleotide
gattttgcttattaagctca

SEQ ID NO: 1156 - DNA, 20 bp, Artificial sequence
  Synthetic oligonucleotide
gtgagccaatgatcccatca

SEQ ID NO: 1157 - DNA, 20 bp, Artificial sequence
  Synthetic oligonucleotide
tcagccccttaaaaatcatc

SEQ ID NO: 1158 - DNA, 20 bp, Artificial sequence
  Synthetic oligonucleotide
ggatatgttcagactcagat

SEQ ID NO: 1159 - DNA, 20 bp, Artificial sequence
  Synthetic oligonucleotide
ccagttcatactcagaaata

SEQ ID NO: 1160 - DNA, 20 bp, Artificial sequence
  Synthetic oligonucleotide
tggcactgaatattaagcag

SEQ ID NO: 1161 - DNA, 20 bp, Artificial sequence
  Synthetic oligonucleotide
agtgtgtattaccaacaact

SEQ ID NO: 1162 - DNA, 20 bp, Artificial sequence
  Synthetic oligonucleotide
ctgtataataatgtaatgct

SEQ ID NO: 1163 - DNA, 20 bp, Artificial sequence
  Synthetic oligonucleotide
tctatttaaaacactgaatc

SEQ ID NO: 1164 - DNA, 20 bp, Artificial sequence
  Synthetic oligonucleotide
gggagcaatgaattctctca

SEQ ID NO: 1165 - DNA, 20 bp, Artificial sequence
  Synthetic oligonucleotide
ctactatatctaaacactat

SEQ ID NO: 1166 - DNA, 20 bp, Artificial sequence
  Synthetic oligonucleotide
ttcctccatccatcccccta

SEQ ID NO: 1167 - DNA, 20 bp, Artificial sequence
  Synthetic oligonucleotide
agcccattttttcatccagt

SEQ ID NO: 1168 - DNA, 20 bp, Artificial sequence
  Synthetic oligonucleotide
tgtggctttaccgcctaaca

SEQ ID NO: 1169 - DNA, 20 bp, Artificial sequence
  Synthetic oligonucleotide
tctcctctttataccaggga

SEQ ID NO: 1170 - DNA, 20 bp, Artificial sequence
  Synthetic oligonucleotide
tatttttttactacctccac

SEQ ID NO: 1171 - DNA, 20 bp, Artificial sequence
  Synthetic oligonucleotide
agtgaccacactatccgatg

SEQ ID NO: 1172 - DNA, 20 bp, Artificial sequence
  Synthetic oligonucleotide
cttgaatttaaaacccatat

SEQ ID NO: 1173 - DNA, 20 bp, Artificial sequence
  Synthetic oligonucleotide
tgcacacatctcaaataggt

SEQ ID NO: 1174 - DNA, 20 bp, Artificial sequence
  Synthetic oligonucleotide
tttgcctaaattctgccttt

SEQ ID NO: 1175 - DNA, 20 bp, Artificial sequence
  Synthetic oligonucleotide
ctcaccaacctcatctctcg

SEQ ID NO: 1176 - DNA, 20 bp, Artificial sequence
  Synthetic oligonucleotide
acaactaactatatattgtt

SEQ ID NO: 1177 - DNA, 20 bp, Artificial sequence
  Synthetic oligonucleotide
gtttccctctaaagacttca

SEQ ID NO: 1178 - DNA, 20 bp, Artificial sequence
  Synthetic oligonucleotide
gaccagaagccttagttcca

SEQ ID NO: 1179 - DNA, 20 bp, Artificial sequence
  Synthetic oligonucleotide
acacagaaacatatatgtgc

SEQ ID NO: 1180 - DNA, 20 bp, Artificial sequence
  Synthetic oligonucleotide
attggcccccaaacccattt

SEQ ID NO: 1181 - DNA, 20 bp, Artificial sequence
  Synthetic oligonucleotide
tctgaatgaatattggctat

SEQ ID NO: 1182 - DNA, 20 bp, Artificial sequence
  Synthetic oligonucleotide
gatgagaattaaactgctat

SEQ ID NO: 1183 - DNA, 20 bp, Artificial sequence
  Synthetic oligonucleotide
gagtcatacatatagacttt

SEQ ID NO: 1184 - DNA, 20 bp, Artificial sequence
  Synthetic oligonucleotide
tcaggatacaccaagggagg

SEQ ID NO: 1185 - DNA, 20 bp, Artificial sequence
  Synthetic oligonucleotide
aactgctattatcatacagg

SEQ ID NO: 1186 - DNA, 20 bp, Artificial sequence
  Synthetic oligonucleotide
cccggccaccagggttgccc

SEQ ID NO: 1187 - DNA, 20 bp, Artificial sequence
  Synthetic oligonucleotide
gatactctaccaaaacttca

SEQ ID NO: 1188 - DNA, 20 bp, Artificial sequence
  Synthetic oligonucleotide
cccacgctgcctctacttgc

SEQ ID NO: 1189 - DNA, 20 bp, Artificial sequence
  Synthetic oligonucleotide
gcactagtaaaaagcagaaa

SEQ ID NO: 1190 - DNA, 20 bp, Artificial sequence
  Synthetic oligonucleotide
gtttaaagtgagatacagta

SEQ ID NO: 1191 - DNA, 20 bp, Artificial sequence
  Synthetic oligonucleotide
aggttctttaaaagttcatc

SEQ ID NO: 1192 - DNA, 20 bp, Artificial sequence
  Synthetic oligonucleotide
ggtttgtaccaaacattaaa

SEQ ID NO: 1193 - DNA, 20 bp, Artificial sequence
  Synthetic oligonucleotide
tacaccccagaaaacggttt

SEQ ID NO: 1194 - DNA, 20 bp, Artificial sequence
  Synthetic oligonucleotide
ctattgctccaaaccatgtg

SEQ ID NO: 1195 - DNA, 20 bp, Artificial sequence
  Synthetic oligonucleotide
actggccaacacgctcagaa

SEQ ID NO: 1196 - DNA, 20 bp, Artificial sequence
  Synthetic oligonucleotide
accaacatagaaaattatcc

SEQ ID NO: 1197 - DNA, 20 bp, Artificial sequence
  Synthetic oligonucleotide
agtaaagatcaaactgtgca

SEQ ID NO: 1198 - DNA, 20 bp, Artificial sequence
  Synthetic oligonucleotide
tgggttaaaaacaaatgtgg

SEQ ID NO: 1199 - DNA, 20 bp, Artificial sequence
  Synthetic oligonucleotide
tcagcttctcaaatcaggtg

SEQ ID NO: 1200 - DNA, 20 bp, Artificial sequence
  Synthetic oligonucleotide
tagtaattcttccaggccat

SEQ ID NO: 1201 - DNA, 20 bp, Artificial sequence
  Synthetic oligonucleotide
ttctggcctctttatattaa

SEQ ID NO: 1202 - DNA, 20 bp, Artificial sequence
  Synthetic oligonucleotide
cttgagtcctttcagataag

SEQ ID NO: 1203 - DNA, 20 bp, Artificial sequence
  Synthetic oligonucleotide
tctgatattaaaacatccag

SEQ ID NO: 1204 - DNA, 20 bp, Artificial sequence
  Synthetic oligonucleotide
gcatatggaaaaaagttctc

SEQ ID NO: 1205 - DNA, 20 bp, Artificial sequence
  Synthetic oligonucleotide
tactgaaacaataaacttgt

SEQ ID NO: 1206 - DNA, 20 bp, Artificial sequence
  Synthetic oligonucleotide
tcttcctccttttatatctg

SEQ ID NO: 1207 - DNA, 20 bp, Artificial sequence
  Synthetic oligonucleotide
ggattaaaaattatgacctc

SEQ ID NO: 1208 - DNA, 20 bp, Artificial sequence
  Synthetic oligonucleotide
ggagcagttccttaactatc

SEQ ID NO: 1209 - DNA, 20 bp, Artificial sequence
  Synthetic oligonucleotide
ccccttacccaaacccttgg

SEQ ID NO: 1210 - DNA, 20 bp, Artificial sequence
  Synthetic oligonucleotide
agagataatttttaatgcag

SEQ ID NO: 1211 - DNA, 20 bp, Artificial sequence
  Synthetic oligonucleotide
ccattaaacatttattttgc

SEQ ID NO: 1212 - DNA, 20 bp, Artificial sequence
  Synthetic oligonucleotide
tctatattcccttaaccgta

SEQ ID NO: 1213 - DNA, 20 bp, Artificial sequence
  Synthetic oligonucleotide
cattttcaaccttatgatat

SEQ ID NO: 1214 - DNA, 20 bp, Artificial sequence
  Synthetic oligonucleotide
cagacattcctttaatatgc

SEQ ID NO: 1215 - DNA, 20 bp, Artificial sequence
  Synthetic oligonucleotide
tagaacttttaaagcaaggc

SEQ ID NO: 1216 - DNA, 20 bp, Artificial sequence
  Synthetic oligonucleotide
agtcaaatagtctatcagta

SEQ ID NO: 1217 - DNA, 20 bp, Artificial sequence
  Synthetic oligonucleotide
acatgattttaaaagtctta

SEQ ID NO: 1218 - DNA, 20 bp, Artificial sequence
  Synthetic oligonucleotide
tccccacacccttaaactgc

SEQ ID NO: 1219 - DNA, 20 bp, Artificial sequence
  Synthetic oligonucleotide
tacacataaatttatatctg

SEQ ID NO: 1220 - DNA, 20 bp, Artificial sequence
  Synthetic oligonucleotide
tggttctatatttatgtacc

SEQ ID NO: 1221 - DNA, 20 bp, Artificial sequence
  Synthetic oligonucleotide
ttgtctaaacctgtttgagg

SEQ ID NO: 1222 - DNA, 20 bp, Artificial sequence
  Synthetic oligonucleotide
gctaccaaaatacagaactt

SEQ ID NO: 1223 - DNA, 20 bp, Artificial sequence
  Synthetic oligonucleotide
gcaccattttaaaaatggct

SEQ ID NO: 1224 - DNA, 20 bp, Artificial sequence
  Synthetic oligonucleotide
tcatctaaacctaatacggc

SEQ ID NO: 1225 - DNA, 20 bp, Artificial sequence
  Synthetic oligonucleotide
tctgtcttttcctggtaaga

SEQ ID NO: 1226 - DNA, 20 bp, Artificial sequence
  Synthetic oligonucleotide
ctgttgtttgccacatttcc

SEQ ID NO: 1227 - DNA, 20 bp, Artificial sequence
  Synthetic oligonucleotide
ccagagctaattcctaggag

SEQ ID NO: 1228 - DNA, 20 bp, Artificial sequence
  Synthetic oligonucleotide
ttgggcagtgaaagaaatgg

SEQ ID NO: 1229 - DNA, 20 bp, Artificial sequence
  Synthetic oligonucleotide
acctacagtgacatctcata

SEQ ID NO: 1230 - DNA, 20 bp, Artificial sequence
  Synthetic oligonucleotide
tctgttcacaaaaatgtgtt

SEQ ID NO: 1231 - DNA, 20 bp, Artificial sequence
  Synthetic oligonucleotide
ctctttcatttaatcattaa

SEQ ID NO: 1232 - DNA, 20 bp, Artificial sequence
  Synthetic oligonucleotide
tccccaatcaaatttgtgat

SEQ ID NO: 1233 - DNA, 20 bp, Artificial sequence
  Synthetic oligonucleotide
gtagtggtacacacccatag

SEQ ID NO: 1234 - DNA, 20 bp, Artificial sequence
  Synthetic oligonucleotide
ggcatctttccacagtctta

SEQ ID NO: 1235 - DNA, 20 bp, Artificial sequence
  Synthetic oligonucleotide
ccgagccatctaagttgaag

SEQ ID NO: 1236 - DNA, 20 bp, Artificial sequence
  Synthetic oligonucleotide
atccagttcatactcagaaa

SEQ ID NO: 1237 - DNA, 20 bp, Artificial sequence
  Synthetic oligonucleotide
cacccacgccaggacagtcg

SEQ ID NO: 1238 - DNA, 20 bp, Artificial sequence
  Synthetic oligonucleotide
ttccagcaccagaacagaca

SEQ ID NO: 1239 - DNA, 20 bp, Artificial sequence
  Synthetic oligonucleotide
tctgtataataatgtaatgc

SEQ ID NO: 1240 - DNA, 20 bp, Artificial sequence
  Synthetic oligonucleotide
gttctatttaaaacactgaa

SEQ ID NO: 1241 - DNA, 20 bp, Artificial sequence
  Synthetic oligonucleotide
catacaaatttcgcctgttg

SEQ ID NO: 1242 - DNA, 20 bp, Artificial sequence
  Synthetic oligonucleotide
actactatatctaaacacta

SEQ ID NO: 1243 - DNA, 20 bp, Artificial sequence
  Synthetic oligonucleotide
taccccttcctccatccatc

SEQ ID NO: 1244 - DNA, 20 bp, Artificial sequence
  Synthetic oligonucleotide
ctcaatatagcccatttttt

SEQ ID NO: 1245 - DNA, 20 bp, Artificial sequence
  Synthetic oligonucleotide
gacctcccccagggagagga

SEQ ID NO: 1246 - DNA, 20 bp, Artificial sequence
  Synthetic oligonucleotide
ttctcctctttataccaggg

SEQ ID NO: 1247 - DNA, 20 bp, Artificial sequence
  Synthetic oligonucleotide
actatttttttactacctcc

SEQ ID NO: 1248 - DNA, 20 bp, Artificial sequence
  Synthetic oligonucleotide
accagtgaccacactatccg

SEQ ID NO: 1249 - DNA, 20 bp, Artificial sequence
  Synthetic oligonucleotide
ccttgaatttaaaacccata

SEQ ID NO: 1250 - DNA, 20 bp, Artificial sequence
  Synthetic oligonucleotide
gaaagttaaaatcttgttgc

SEQ ID NO: 1251 - DNA, 20 bp, Artificial sequence
  Synthetic oligonucleotide
ctttttgcctaaattctgcc

SEQ ID NO: 1252 - DNA, 20 bp, Artificial sequence
  Synthetic oligonucleotide
tctcaccaacctcatctctc

SEQ ID NO: 1253 - DNA, 20 bp, Artificial sequence
  Synthetic oligonucleotide
aacaactaactatatattgt

SEQ ID NO: 1254 - DNA, 20 bp, Artificial sequence
  Synthetic oligonucleotide
agtgcaaaagtcaggataca

SEQ ID NO: 1255 - DNA, 20 bp, Artificial sequence
  Synthetic oligonucleotide
tcagaagaccagaagcctta

SEQ ID NO: 1256 - DNA, 20 bp, Artificial sequence
  Synthetic oligonucleotide
acatttacatcacacacaga

SEQ ID NO: 1257 - DNA, 20 bp, Artificial sequence
  Synthetic oligonucleotide
ggattttatcccagtcattg

SEQ ID NO: 1258 - DNA, 20 bp, Artificial sequence
  Synthetic oligonucleotide
gaggaatgaaaatggtagat

SEQ ID NO: 1259 - DNA, 20 bp, Artificial sequence
  Synthetic oligonucleotide
cagatgagaattaaactgct

SEQ ID NO: 1260 - DNA, 20 bp, Artificial sequence
  Synthetic oligonucleotide
agagtcatacatatagactt

SEQ ID NO: 1261 - DNA, 20 bp, Artificial sequence
  Synthetic oligonucleotide
atggagttcaggatacacca

SEQ ID NO: 1262 - DNA, 20 bp, Artificial sequence
  Synthetic oligonucleotide
ggtcttagattttatgagct

SEQ ID NO: 1263 - DNA, 20 bp, Artificial sequence
  Synthetic oligonucleotide
ggccccggccaccagggttg

SEQ ID NO: 1264 - DNA, 20 bp, Artificial sequence
  Synthetic oligonucleotide
ggatactctaccaaaacttc

SEQ ID NO: 1265 - DNA, 20 bp, Artificial sequence
  Synthetic oligonucleotide
gtttcctttcccccacgctg

SEQ ID NO: 1266 - DNA, 20 bp, Artificial sequence
  Synthetic oligonucleotide
tgcactagtaaaaagcagaa

SEQ ID NO: 1267 - DNA, 20 bp, Artificial sequence
  Synthetic oligonucleotide
ttttttccccaaagagttta

SEQ ID NO: 1268 - DNA, 20 bp, Artificial sequence
  Synthetic oligonucleotide
aaggttctttaaaagttcat

SEQ ID NO: 1269 - DNA, 20 bp, Artificial sequence
  Synthetic oligonucleotide
tgggtttgtaccaaacatta

SEQ ID NO: 1270 - DNA, 20 bp, Artificial sequence
  Synthetic oligonucleotide
ctaaacctattcaaatgttt

SEQ ID NO: 1271 - DNA, 20 bp, Artificial sequence
  Synthetic oligonucleotide
atgatgttcctattgctcca

SEQ ID NO: 1272 - DNA, 20 bp, Artificial sequence
  Synthetic oligonucleotide
tcttcctatttgaagagaaa

SEQ ID NO: 1273 - DNA, 20 bp, Artificial sequence
  Synthetic oligonucleotide
gggaaaacgaaaagttgacc

SEQ ID NO: 1274 - DNA, 20 bp, Artificial sequence
  Synthetic oligonucleotide
tcagtaaagatcaaactgtg

SEQ ID NO: 1275 - DNA, 20 bp, Artificial sequence
  Synthetic oligonucleotide
tctgggttaaaaacaaatgt

SEQ ID NO: 1276 - DNA, 20 bp, Artificial sequence
  Synthetic oligonucleotide
cttcagcttctcaaatcagg

SEQ ID NO: 1277 - DNA, 20 bp, Artificial sequence
  Synthetic oligonucleotide
ataggtatagtttaagagcc

SEQ ID NO: 1278 - DNA, 20 bp, Artificial sequence
  Synthetic oligonucleotide
atgctccgtatttattctgg

SEQ ID NO: 1279 - DNA, 20 bp, Artificial sequence
  Synthetic oligonucleotide
gacttgagtcctttcagata

SEQ ID NO: 1280 - DNA, 20 bp, Artificial sequence
  Synthetic oligonucleotide
atctgatattaaaacatcca

SEQ ID NO: 1281 - DNA, 20 bp, Artificial sequence
  Synthetic oligonucleotide
tacaatattttacactggaa

SEQ ID NO: 1282 - DNA, 20 bp, Artificial sequence
  Synthetic oligonucleotide
gcactgttattttattagta

SEQ ID NO: 1283 - DNA, 20 bp, Artificial sequence
  Synthetic oligonucleotide
ctgtggttttaaaggctgta

SEQ ID NO: 1284 - DNA, 20 bp, Artificial sequence
  Synthetic oligonucleotide
ggttttaaaaacatcctcct

SEQ ID NO: 1285 - DNA, 20 bp, Artificial sequence
  Synthetic oligonucleotide
ttttagcacctttaaactct

SEQ ID NO: 1286 - DNA, 20 bp, Artificial sequence
  Synthetic oligonucleotide
ctctcattttaaagttttct

SEQ ID NO: 1287 - DNA, 20 bp, Artificial sequence
  Synthetic oligonucleotide
atctttattcaaaaatgcaa

SEQ ID NO: 1288 - DNA, 20 bp, Artificial sequence
  Synthetic oligonucleotide
ttcatgttttaaagctgaga

SEQ ID NO: 1289 - DNA, 20 bp, Artificial sequence
  Synthetic oligonucleotide
ctcacaattcaaaattattc

SEQ ID NO: 1290 - DNA, 20 bp, Artificial sequence
  Synthetic oligonucleotide
aaccttagaaatgtacattt

SEQ ID NO: 1291 - DNA, 20 bp, Artificial sequence
  Synthetic oligonucleotide
ctagcaattcaaaacaatat

SEQ ID NO: 1292 - DNA, 20 bp, Artificial sequence
  Synthetic oligonucleotide
cttctccttccttaatagat

SEQ ID NO: 1293 - DNA, 20 bp, Artificial sequence
  Synthetic oligonucleotide
tctcaaggcccttaattgcc

SEQ ID NO: 1294 - DNA, 20 bp, Artificial sequence
  Synthetic oligonucleotide
acttttaaatccccctaaag

SEQ ID NO: 1295 - DNA, 20 bp, Artificial sequence
  Synthetic oligonucleotide
ctcacatttctttatacaca

SEQ ID NO: 1296 - DNA, 20 bp, Artificial sequence
  Synthetic oligonucleotide
gtgagattttaaagacattc

SEQ ID NO: 1297 - DNA, 20 bp, Artificial sequence
  Synthetic oligonucleotide
gatgccaaactattatctca

SEQ ID NO: 1298 - DNA, 20 bp, Artificial sequence
  Synthetic oligonucleotide
agacaattttaaaagcttcc

SEQ ID NO: 1299 - DNA, 20 bp, Artificial sequence
  Synthetic oligonucleotide
tctcttaaccaaagaatctg

SEQ ID NO: 1300 - DNA, 20 bp, Artificial sequence
  Synthetic oligonucleotide
atgctgttcctttataacgg

SEQ ID NO: 1301 - DNA, 20 bp, Artificial sequence
  Synthetic oligonucleotide
aatttctaaatttagcccag

SEQ ID NO: 1302 - DNA, 20 bp, Artificial sequence
  Synthetic oligonucleotide
tcccctcactccaacggcat

SEQ ID NO: 1303 - DNA, 20 bp, Artificial sequence
  Synthetic oligonucleotide
ctcccatgaaaccacaataa

SEQ ID NO: 1304 - DNA, 20 bp, Artificial sequence
  Synthetic oligonucleotide
ctgacttttatatgcaaacc

SEQ ID NO: 1305 - DNA, 20 bp, Artificial sequence
  Synthetic oligonucleotide
ctcgatagccaggaaagctc

SEQ ID NO: 1306 - DNA, 20 bp, Artificial sequence
  Synthetic oligonucleotide
actgtaaacctacagtgaca

SEQ ID NO: 1307 - DNA, 20 bp, Artificial sequence
  Synthetic oligonucleotide
ctctgttcacaaaaatgtgt

SEQ ID NO: 1308 - DNA, 20 bp, Artificial sequence
  Synthetic oligonucleotide
ttctctttcatttaatcatt

SEQ ID NO: 1309 - DNA, 20 bp, Artificial sequence
  Synthetic oligonucleotide
ttccccaatcaaatttgtga

SEQ ID NO: 1310 - DNA, 20 bp, Artificial sequence
  Synthetic oligonucleotide
gagattatctcctatgaaga

SEQ ID NO: 1311 - DNA, 20 bp, Artificial sequence
  Synthetic oligonucleotide
agcatttttctcctacattg

SEQ ID NO: 1312 - DNA, 20 bp, Artificial sequence
  Synthetic oligonucleotide
ggcccgagccatctaagttg

SEQ ID NO: 1313 - DNA, 20 bp, Artificial sequence
  Synthetic oligonucleotide
aatccagttcatactcagaa

SEQ ID NO: 1314 - DNA, 20 bp, Artificial sequence
  Synthetic oligonucleotide
actcacacccacgccaggac

SEQ ID NO: 1315 - DNA, 20 bp, Artificial sequence
  Synthetic oligonucleotide
ccacaaacaaaaatgtggtt

SEQ ID NO: 1316 - DNA, 20 bp, Artificial sequence
  Synthetic oligonucleotide
ctgttctgtataataatgta

SEQ ID NO: 1317 - DNA, 20 bp, Artificial sequence
  Synthetic oligonucleotide
tgttctatttaaaacactga

SEQ ID NO: 1318 - DNA, 20 bp, Artificial sequence
  Synthetic oligonucleotide
gacatacaaatttcgcctgt

SEQ ID NO: 1319 - DNA, 20 bp, Artificial sequence
  Synthetic oligonucleotide
aactactatatctaaacact

SEQ ID NO: 1320 - DNA, 20 bp, Artificial sequence
  Synthetic oligonucleotide
ctgcctaccccttcctccat

SEQ ID NO: 1321 - DNA, 20 bp, Artificial sequence
  Synthetic oligonucleotide
gacagctcaatatagcccat

SEQ ID NO: 1322 - DNA, 20 bp, Artificial sequence
  Synthetic oligonucleotide
agccagaactaaagtgggct

SEQ ID NO: 1323 - DNA, 20 bp, Artificial sequence
  Synthetic oligonucleotide
ccttctcctctttataccag

SEQ ID NO: 1324 - DNA, 20 bp, Artificial sequence
  Synthetic oligonucleotide
atactatttttttactacct

SEQ ID NO: 1325 - DNA, 20 bp, Artificial sequence
  Synthetic oligonucleotide
gacaccagtgaccacactat

SEQ ID NO: 1326 - DNA, 20 bp, Artificial sequence
  Synthetic oligonucleotide
tccttgaatttaaaacccat

SEQ ID NO: 1327 - DNA, 20 bp, Artificial sequence
  Synthetic oligonucleotide
tgaaagttaaaatcttgttg

SEQ ID NO: 1328 - DNA, 20 bp, Artificial sequence
  Synthetic oligonucleotide
tctttttgcctaaattctgc

SEQ ID NO: 1329 - DNA, 20 bp, Artificial sequence
  Synthetic oligonucleotide
tcctctcaccaacctcatct

SEQ ID NO: 1330 - DNA, 20 bp, Artificial sequence
  Synthetic oligonucleotide
cttttagaaactaactctgg

SEQ ID NO: 1331 - DNA, 20 bp, Artificial sequence
  Synthetic oligonucleotide
gtactataattgattagtgc

SEQ ID NO: 1332 - DNA, 20 bp, Artificial sequence
  Synthetic oligonucleotide
gtgacattcagaagaccaga

SEQ ID NO: 1333 - DNA, 20 bp, Artificial sequence
  Synthetic oligonucleotide
actacatttacatcacacac

SEQ ID NO: 1334 - DNA, 20 bp, Artificial sequence
  Synthetic oligonucleotide
ttaggattttatcccagtca

SEQ ID NO: 1335 - DNA, 20 bp, Artificial sequence
  Synthetic oligonucleotide
gcattatagaaaatactaaa

SEQ ID NO: 1336 - DNA, 20 bp, Artificial sequence
  Synthetic oligonucleotide
gcagatgagaattaaactgc

SEQ ID NO: 1337 - DNA, 20 bp, Artificial sequence
  Synthetic oligonucleotide
tcatatagagtcatacatat

SEQ ID NO: 1338 - DNA, 20 bp, Artificial sequence
  Synthetic oligonucleotide
tgaacattccaaagtggagc

SEQ ID NO: 1339 - DNA, 20 bp, Artificial sequence
  Synthetic oligonucleotide
gcggtcttagattttatgag

SEQ ID NO: 1340 - DNA, 20 bp, Artificial sequence
  Synthetic oligonucleotide
ccctgccggcccatgcctcc

SEQ ID NO: 1341 - DNA, 20 bp, Artificial sequence
  Synthetic oligonucleotide
cacaaaaaaaggatactcta

SEQ ID NO: 1342 - DNA, 20 bp, Artificial sequence
  Synthetic oligonucleotide
atctggatacaaatgataag

SEQ ID NO: 1343 - DNA, 20 bp, Artificial sequence
  Synthetic oligonucleotide
gtccaccacaacaccctggt

SEQ ID NO: 1344 - DNA, 20 bp, Artificial sequence
  Synthetic oligonucleotide
cagagctgaaatgtagttac

SEQ ID NO: 1345 - DNA, 20 bp, Artificial sequence
  Synthetic oligonucleotide
gcaaggttctttaaaagttc

SEQ ID NO: 1346 - DNA, 20 bp, Artificial sequence
  Synthetic oligonucleotide
atgaaataccctttctgggt

SEQ ID NO: 1347 - DNA, 20 bp, Artificial sequence
  Synthetic oligonucleotide
tagctattctaaacctattc

SEQ ID NO: 1348 - DNA, 20 bp, Artificial sequence
  Synthetic oligonucleotide
tgatgatgttcctattgctc

SEQ ID NO: 1349 - DNA, 20 bp, Artificial sequence
  Synthetic oligonucleotide
gaagaatttctacccctgtc

SEQ ID NO: 1350 - DNA, 20 bp, Artificial sequence
  Synthetic oligonucleotide
atcccaaactaaactgggtg

SEQ ID NO: 1351 - DNA, 20 bp, Artificial sequence
  Synthetic oligonucleotide
aacatatttcagtaaagatc

SEQ ID NO: 1352 - DNA, 20 bp, Artificial sequence
  Synthetic oligonucleotide
tctatttcagaaattctggg

SEQ ID NO: 1353 - DNA, 20 bp, Artificial sequence
  Synthetic oligonucleotide
tgcttcaaaattttgttttc

SEQ ID NO: 1354 - DNA, 20 bp, Artificial sequence
  Synthetic oligonucleotide
ttcccctccctcagacgagg

SEQ ID NO: 1355 - DNA, 20 bp, Artificial sequence
  Synthetic oligonucleotide
attctgagaagatgctccgt

SEQ ID NO: 1356 - DNA, 20 bp, Artificial sequence
  Synthetic oligonucleotide
aagacttgagtcctttcaga

SEQ ID NO: 1357 - DNA, 20 bp, Artificial sequence
  Synthetic oligonucleotide
gatctgatattaaaacatcc

SEQ ID NO: 1358 - DNA, 20 bp, Artificial sequence
  Synthetic oligonucleotide
agtacaatattttacactgg

SEQ ID NO: 1359 - DNA, 20 bp, Artificial sequence
  Synthetic oligonucleotide
gtcaagttttaaaatgtgac

SEQ ID NO: 1360 - DNA, 20 bp, Artificial sequence
  Synthetic oligonucleotide
actgaaacaatttatctaag

SEQ ID NO: 1361 - DNA, 20 bp, Artificial sequence
  Synthetic oligonucleotide
acaaaaataatttaagccac

SEQ ID NO: 1362 - DNA, 20 bp, Artificial sequence
  Synthetic oligonucleotide
tactatcacctttaaacttt

SEQ ID NO: 1363 - DNA, 20 bp, Artificial sequence
  Synthetic oligonucleotide
accgccaaaaccaaccaggg

SEQ ID NO: 1364 - DNA, 20 bp, Artificial sequence
  Synthetic oligonucleotide
ctaatctatcaaataaagga

SEQ ID NO: 1365 - DNA, 20 bp, Artificial sequence
  Synthetic oligonucleotide
gagaggtttcattatgtaaa

SEQ ID NO: 1366 - DNA, 20 bp, Artificial sequence
  Synthetic oligonucleotide
gcacttagacaatgctgcag

SEQ ID NO: 1367 - DNA, 20 bp, Artificial sequence
  Synthetic oligonucleotide
ggtaagttattttaaaactt

SEQ ID NO: 1368 - DNA, 20 bp, Artificial sequence
  Synthetic oligonucleotide
agttttacgatatatgaatc

SEQ ID NO: 1369 - DNA, 20 bp, Artificial sequence
  Synthetic oligonucleotide
taccattatttttagctttt

SEQ ID NO: 1370 - DNA, 20 bp, Artificial sequence
  Synthetic oligonucleotide
cagtttattctttacccaaa

SEQ ID NO: 1371 - DNA, 20 bp, Artificial sequence
  Synthetic oligonucleotide
cccacattttaaagatgcag

SEQ ID NO: 1372 - DNA, 20 bp, Artificial sequence
  Synthetic oligonucleotide
tccagaaacctttattattg

SEQ ID NO: 1373 - DNA, 20 bp, Artificial sequence
  Synthetic oligonucleotide
aacaggttacaaatacggtt

SEQ ID NO: 1374 - DNA, 20 bp, Artificial sequence
  Synthetic oligonucleotide
attctgttttaaattccttt

SEQ ID NO: 1375 - DNA, 20 bp, Artificial sequence
  Synthetic oligonucleotide
atgcaatttcaaaagctggc

SEQ ID NO: 1376 - DNA, 20 bp, Artificial sequence
  Synthetic oligonucleotide
gtggatactttttaaaactc

SEQ ID NO: 1377 - DNA, 20 bp, Artificial sequence
  Synthetic oligonucleotide
gtcgcaaacctttatggagt

SEQ ID NO: 1378 - DNA, 20 bp, Artificial sequence
  Synthetic oligonucleotide
caaatccaaatttattcttc

SEQ ID NO: 1379 - DNA, 20 bp, Artificial sequence
  Synthetic oligonucleotide
catctaatcccctcactcca

SEQ ID NO: 1380 - DNA, 20 bp, Artificial sequence
  Synthetic oligonucleotide
gcctcccatgaaaccacaat

SEQ ID NO: 1381 - DNA, 20 bp, Artificial sequence
  Synthetic oligonucleotide
cctgacttttatatgcaaac

SEQ ID NO: 1382 - DNA, 20 bp, Artificial sequence
  Synthetic oligonucleotide
aagtacgctcgatagccagg

SEQ ID NO: 1383 - DNA, 20 bp, Artificial sequence
  Synthetic oligonucleotide
aagactgtaaacctacagtg

SEQ ID NO: 1384 - DNA, 20 bp, Artificial sequence
  Synthetic oligonucleotide
cctctgttcacaaaaatgtg

SEQ ID NO: 1385 - DNA, 20 bp, Artificial sequence
  Synthetic oligonucleotide
atttctctttcatttaatca

SEQ ID NO: 1386 - DNA, 20 bp, Artificial sequence
  Synthetic oligonucleotide
cttccccaatcaaatttgtg

SEQ ID NO: 1387 - DNA, 20 bp, Artificial sequence
  Synthetic oligonucleotide
agagattatctcctatgaag

SEQ ID NO: 1388 - DNA, 20 bp, Artificial sequence
  Synthetic oligonucleotide
agggatagtgacaaacacgg

SEQ ID NO: 1389 - DNA, 20 bp, Artificial sequence
  Synthetic oligonucleotide
agggcccgagccatctaagt

SEQ ID NO: 1390 - DNA, 20 bp, Artificial sequence
  Synthetic oligonucleotide
cccctcaaatccagttcata

SEQ ID NO: 1391 - DNA, 20 bp, Artificial sequence
  Synthetic oligonucleotide
catcatgataacaactgctg

SEQ ID NO: 1392 - DNA, 20 bp, Artificial sequence
  Synthetic oligonucleotide
cccacaaacaaaaatgtggt

SEQ ID NO: 1393 - DNA, 20 bp, Artificial sequence
  Synthetic oligonucleotide
gagtaaaatgatcagtgggt

SEQ ID NO: 1394 - DNA, 20 bp, Artificial sequence
  Synthetic oligonucleotide
gtgttctatttaaaacactg

SEQ ID NO: 1395 - DNA, 20 bp, Artificial sequence
  Synthetic oligonucleotide
agacatacaaatttcgcctg

SEQ ID NO: 1396 - DNA, 20 bp, Artificial sequence
  Synthetic oligonucleotide
gtcaataactactatatcta

SEQ ID NO: 1397 - DNA, 20 bp, Artificial sequence
  Synthetic oligonucleotide
tctgcctaccccttcctcca

SEQ ID NO: 1398 - DNA, 20 bp, Artificial sequence
  Synthetic oligonucleotide
ccacagataaccaaagcacg

SEQ ID NO: 1399 - DNA, 20 bp, Artificial sequence
  Synthetic oligonucleotide
ccagccagaactaaagtggg

SEQ ID NO: 1400 - DNA, 20 bp, Artificial sequence
  Synthetic oligonucleotide
ggccccttctcctctttata

SEQ ID NO: 1401 - DNA, 20 bp, Artificial sequence
  Synthetic oligonucleotide
tgatactatttttttactac

SEQ ID NO: 1402 - DNA, 20 bp, Artificial sequence
  Synthetic oligonucleotide
gagacagaacatacacgcaa

SEQ ID NO: 1403 - DNA, 20 bp, Artificial sequence
  Synthetic oligonucleotide
attccttgaatttaaaaccc

SEQ ID NO: 1404 - DNA, 20 bp, Artificial sequence
  Synthetic oligonucleotide
gtgaaagttaaaatcttgtt

SEQ ID NO: 1405 - DNA, 20 bp, Artificial sequence
  Synthetic oligonucleotide
tgtttctttttgcctaaatt

SEQ ID NO: 1406 - DNA, 20 bp, Artificial sequence
  Synthetic oligonucleotide
ttttcctctcaccaacctca

SEQ ID NO: 1407 - DNA, 20 bp, Artificial sequence
  Synthetic oligonucleotide
acttttagaaactaactctg

SEQ ID NO: 1408 - DNA, 20 bp, Artificial sequence
  Synthetic oligonucleotide
gccctttataacaggtacta

SEQ ID NO: 1409 - DNA, 20 bp, Artificial sequence
  Synthetic oligonucleotide
tgtgacattcagaagaccag

SEQ ID NO: 1410 - DNA, 20 bp, Artificial sequence
  Synthetic oligonucleotide
tcaaaactacatttacatca

SEQ ID NO: 1411 - DNA, 20 bp, Artificial sequence
  Synthetic oligonucleotide
ggtttaggattttatcccag

SEQ ID NO: 1412 - DNA, 20 bp, Artificial sequence
  Synthetic oligonucleotide
tgcattatagaaaatactaa

SEQ ID NO: 1413 - DNA, 20 bp, Artificial sequence
  Synthetic oligonucleotide
ggcagatgagaattaaactg

SEQ ID NO: 1414 - DNA, 20 bp, Artificial sequence
  Synthetic oligonucleotide
cagggcttctcatatagagt

SEQ ID NO: 1415 - DNA, 20 bp, Artificial sequence
  Synthetic oligonucleotide
ggcacttgaacattccaaag

SEQ ID NO: 1416 - DNA, 20 bp, Artificial sequence
  Synthetic oligonucleotide
gctcacaagcccagcgcggt

SEQ ID NO: 1417 - DNA, 20 bp, Artificial sequence
  Synthetic oligonucleotide
tgttgtaaaccaagctccac

SEQ ID NO: 1418 - DNA, 20 bp, Artificial sequence
  Synthetic oligonucleotide
gtccaaacacaaaaaaagga

SEQ ID NO: 1419 - DNA, 20 bp, Artificial sequence
  Synthetic oligonucleotide
tattttagcctacagtacag

SEQ ID NO: 1420 - DNA, 20 bp, Artificial sequence
  Synthetic oligonucleotide
cctgtccaccacaacaccct

SEQ ID NO: 1421 - DNA, 20 bp, Artificial sequence
  Synthetic oligonucleotide
tcagcaattctgcagagctg

SEQ ID NO: 1422 - DNA, 20 bp, Artificial sequence
  Synthetic oligonucleotide
aagttataaactcaatatgt

SEQ ID NO: 1423 - DNA, 20 bp, Artificial sequence
  Synthetic oligonucleotide
tatgaaataccctttctggg

SEQ ID NO: 1424 - DNA, 20 bp, Artificial sequence
  Synthetic oligonucleotide
tctagctattctaaacctat

SEQ ID NO: 1425 - DNA, 20 bp, Artificial sequence
  Synthetic oligonucleotide
ccacaaaaattatgatgatg

SEQ ID NO: 1426 - DNA, 20 bp, Artificial sequence
  Synthetic oligonucleotide
cgaagaatttctacccctgt

SEQ ID NO: 1427 - DNA, 20 bp, Artificial sequence
  Synthetic oligonucleotide
tcatcccaaactaaactggg

SEQ ID NO: 1428 - DNA, 20 bp, Artificial sequence
  Synthetic oligonucleotide
gcaacatatttcagtaaaga

SEQ ID NO: 1429 - DNA, 20 bp, Artificial sequence
  Synthetic oligonucleotide
cttaaattctctatttcaga

SEQ ID NO: 1430 - DNA, 20 bp, Artificial sequence
  Synthetic oligonucleotide
gtgcttcaaaattttgtttt

SEQ ID NO: 1431 - DNA, 20 bp, Artificial sequence
  Synthetic oligonucleotide
accgagttcccctccctcag

SEQ ID NO: 1432 - DNA, 20 bp, Artificial sequence
  Synthetic oligonucleotide
acaggaatactattctgaga

SEQ ID NO: 1433 - DNA, 20 bp, Artificial sequence
  Synthetic oligonucleotide
gaagcctccaatgtatctgc

SEQ ID NO: 1434 - DNA, 20 bp, Artificial sequence
  Synthetic oligonucleotide
ggtgtctgttttcccttggc

SEQ ID NO: 1435 - DNA, 20 bp, Artificial sequence
  Synthetic oligonucleotide
aagtacaatattttacactg

SEQ ID NO: 1436 - DNA, 20 bp, Artificial sequence
  Synthetic oligonucleotide
ggccataaaattgtaaactg

SEQ ID NO: 1437 - DNA, 20 bp, Artificial sequence
  Synthetic oligonucleotide
aacatctaaatttataatga

SEQ ID NO: 1438 - DNA, 20 bp, Artificial sequence
  Synthetic oligonucleotide
aggtggttacaaacataaat

SEQ ID NO: 1439 - DNA, 20 bp, Artificial sequence
  Synthetic oligonucleotide
agctaaaaacccaacatggg

SEQ ID NO: 1440 - DNA, 20 bp, Artificial sequence
  Synthetic oligonucleotide
gacagttatttttaagaggc

SEQ ID NO: 1441 - DNA, 20 bp, Artificial sequence
  Synthetic oligonucleotide
ttggacttttaaatgtaagt

SEQ ID NO: 1442 - DNA, 20 bp, Artificial sequence
  Synthetic oligonucleotide
tgtgtctaaatttatggtag

SEQ ID NO: 1443 - DNA, 20 bp, Artificial sequence
  Synthetic oligonucleotide
gttgaatttcaaaaatcaaa

SEQ ID NO: 1444 - DNA, 20 bp, Artificial sequence
  Synthetic oligonucleotide
caggaaaaaatacagggtgt

SEQ ID NO: 1445 - DNA, 20 bp, Artificial sequence
  Synthetic oligonucleotide
acctaaaaaaatatagatcc

SEQ ID NO: 1446 - DNA, 20 bp, Artificial sequence
  Synthetic oligonucleotide
ctaattaatccttaaattgc

SEQ ID NO: 1447 - DNA, 20 bp, Artificial sequence
  Synthetic oligonucleotide
tttcaatatatttacacact

SEQ ID NO: 1448 - DNA, 20 bp, Artificial sequence
  Synthetic oligonucleotide
ctcacacaaatttacattct

SEQ ID NO: 1449 - DNA, 20 bp, Artificial sequence
  Synthetic oligonucleotide
acctaaaaaatacatcttta

SEQ ID NO: 1450 - DNA, 20 bp, Artificial sequence
  Synthetic oligonucleotide
ctgaagattccttaatatct

SEQ ID NO: 1451 - DNA, 20 bp, Artificial sequence
  Synthetic oligonucleotide
ctaatgttttaaaactcttg

SEQ ID NO: 1452 - DNA, 20 bp, Artificial sequence
  Synthetic oligonucleotide
ttccaattttaaaaaacctg

SEQ ID NO: 1453 - DNA, 20 bp, Artificial sequence
  Synthetic oligonucleotide
ctgtcaaaaatataatacct

SEQ ID NO: 1454 - DNA, 20 bp, Artificial sequence
  Synthetic oligonucleotide
tgtcgcaaacctttatggag

SEQ ID NO: 1455 - DNA, 20 bp, Artificial sequence
  Synthetic oligonucleotide
aagtcctttcaaagccaagt

SEQ ID NO: 1456 - DNA, 20 bp, Artificial sequence
  Synthetic oligonucleotide
agcatctaatcccctcactc

SEQ ID NO: 1457 - DNA, 20 bp, Artificial sequence
  Synthetic oligonucleotide
aacccgtttaccctgcctcc

SEQ ID NO: 1458 - DNA, 20 bp, Artificial sequence
  Synthetic oligonucleotide
gcctgacttttatatgcaaa

SEQ ID NO: 1459 - DNA, 20 bp, Artificial sequence
  Synthetic oligonucleotide
acacttgtagaaagtacgct

SEQ ID NO: 1460 - DNA, 20 bp, Artificial sequence
  Synthetic oligonucleotide
cttccaaagactgtaaacct

SEQ ID NO: 1461 - DNA, 20 bp, Artificial sequence
  Synthetic oligonucleotide
gcctctgttcacaaaaatgt

SEQ ID NO: 1462 - DNA, 20 bp, Artificial sequence
  Synthetic oligonucleotide
aagccaatttctctttcatt

SEQ ID NO: 1463 - DNA, 20 bp, Artificial sequence
  Synthetic oligonucleotide
cacaacttccccaatcaaat

SEQ ID NO: 1464 - DNA, 20 bp, Artificial sequence
  Synthetic oligonucleotide
ctcaagagattatctcctat

SEQ ID NO: 1465 - DNA, 20 bp, Artificial sequence
  Synthetic oligonucleotide
acagggatagtgacaaacac

SEQ ID NO: 1466 - DNA, 20 bp, Artificial sequence
  Synthetic oligonucleotide
ctgtgaatcactttctcagg

SEQ ID NO: 1467 - DNA, 20 bp, Artificial sequence
  Synthetic oligonucleotide
acccctcaaatccagttcat

SEQ ID NO: 1468 - DNA, 20 bp, Artificial sequence
  Synthetic oligonucleotide
gtagacagccagtaagtaca

SEQ ID NO: 1469 - DNA, 20 bp, Artificial sequence
  Synthetic oligonucleotide
acccacaaacaaaaatgtgg

SEQ ID NO: 1470 - DNA, 20 bp, Artificial sequence
  Synthetic oligonucleotide
cgccaatgtgaaaaggcgac

SEQ ID NO: 1471 - DNA, 20 bp, Artificial sequence
  Synthetic oligonucleotide
agtgttctatttaaaacact

SEQ ID NO: 1472 - DNA, 20 bp, Artificial sequence
  Synthetic oligonucleotide
ccagacatacaaatttcgcc

SEQ ID NO: 1473 - DNA, 20 bp, Artificial sequence
  Synthetic oligonucleotide
agtcaataactactatatct

SEQ ID NO: 1474 - DNA, 20 bp, Artificial sequence
  Synthetic oligonucleotide
ccagcaagcccatgtgctca

SEQ ID NO: 1475 - DNA, 20 bp, Artificial sequence
  Synthetic oligonucleotide
agtaccacagataaccaaag

SEQ ID NO: 1476 - DNA, 20 bp, Artificial sequence
  Synthetic oligonucleotide
ctgtatggaaaaacattgca

SEQ ID NO: 1477 - DNA, 20 bp, Artificial sequence
  Synthetic oligonucleotide
atgatgatcattatgtagag

SEQ ID NO: 1478 - DNA, 20 bp, Artificial sequence
  Synthetic oligonucleotide
aatgatactatttttttact

SEQ ID NO: 1479 - DNA, 20 bp, Artificial sequence
  Synthetic oligonucleotide
ggagacagaacatacacgca

SEQ ID NO: 1480 - DNA, 20 bp, Artificial sequence
  Synthetic oligonucleotide
tctgtgaattccttgaattt

SEQ ID NO: 1481 - DNA, 20 bp, Artificial sequence
  Synthetic oligonucleotide
ggtgaaagttaaaatcttgt

SEQ ID NO: 1482 - DNA, 20 bp, Artificial sequence
  Synthetic oligonucleotide
tctttaatcacttcaaaggc

SEQ ID NO: 1483 - DNA, 20 bp, Artificial sequence
  Synthetic oligonucleotide
ggctttcccaataaacctgc

SEQ ID NO: 1484 - DNA, 20 bp, Artificial sequence
  Synthetic oligonucleotide
gtacttttagaaactaactc

SEQ ID NO: 1485 - DNA, 20 bp, Artificial sequence
  Synthetic oligonucleotide
aagccctttataacaggtac

SEQ ID NO: 1486 - DNA, 20 bp, Artificial sequence
  Synthetic oligonucleotide
gcccaacaccaggcagaggt

SEQ ID NO: 1487 - DNA, 20 bp, Artificial sequence
  Synthetic oligonucleotide
tttcaaaactacatttacat

SEQ ID NO: 1488 - DNA, 20 bp, Artificial sequence
  Synthetic oligonucleotide
ttgtaaattttacgaatagt

SEQ ID NO: 1489 - DNA, 20 bp, Artificial sequence
  Synthetic oligonucleotide
accatcaacagatctgcatt

SEQ ID NO: 1490 - DNA, 20 bp, Artificial sequence
  Synthetic oligonucleotide
gcctagccccaaacaggaaa

SEQ ID NO: 1491 - DNA, 20 bp, Artificial sequence
  Synthetic oligonucleotide
aggatgcaccagggcttctc

SEQ ID NO: 1492 - DNA, 20 bp, Artificial sequence
  Synthetic oligonucleotide
gggcctgttttctcctgaag

SEQ ID NO: 1493 - DNA, 20 bp, Artificial sequence
  Synthetic oligonucleotide
ggctcacaagcccagcgcgg

SEQ ID NO: 1494 - DNA, 20 bp, Artificial sequence
  Synthetic oligonucleotide
ctgttgtaaaccaagctcca

SEQ ID NO: 1495 - DNA, 20 bp, Artificial sequence
  Synthetic oligonucleotide
atgaccagccctgtccaaac

SEQ ID NO: 1496 - DNA, 20 bp, Artificial sequence
  Synthetic oligonucleotide
actgtgttattttagcctac

SEQ ID NO: 1497 - DNA, 20 bp, Artificial sequence
  Synthetic oligonucleotide
cccaaccccccttaccccat

SEQ ID NO: 1498 - DNA, 20 bp, Artificial sequence
  Synthetic oligonucleotide
cattgaaactttcaatatct

SEQ ID NO: 1499 - DNA, 20 bp, Artificial sequence
  Synthetic oligonucleotide
caggaatatcacacaagtta

SEQ ID NO: 1500 - DNA, 20 bp, Artificial sequence
  Synthetic oligonucleotide
ctatgaaataccctttctgg

SEQ ID NO: 1501 - DNA, 20 bp, Artificial sequence
  Synthetic oligonucleotide
ttctagctattctaaaccta

SEQ ID NO: 1502 - DNA, 20 bp, Artificial sequence
  Synthetic oligonucleotide
aaccacaaaaattatgatga

SEQ ID NO: 1503 - DNA, 20 bp, Artificial sequence
  Synthetic oligonucleotide
ccgaagaatttctacccctg

SEQ ID NO: 1504 - DNA, 20 bp, Artificial sequence
  Synthetic oligonucleotide
atcatcccaaactaaactgg

SEQ ID NO: 1505 - DNA, 20 bp, Artificial sequence
  Synthetic oligonucleotide
ttttggcaacatatttcagt

SEQ ID NO: 1506 - DNA, 20 bp, Artificial sequence
  Synthetic oligonucleotide
tgttcttaaattctctattt

SEQ ID NO: 1507 - DNA, 20 bp, Artificial sequence
  Synthetic oligonucleotide
gagtgcttcaaaattttgtt

SEQ ID NO: 1508 - DNA, 20 bp, Artificial sequence
  Synthetic oligonucleotide
cagtattctcaaatcgcaga

SEQ ID NO: 1509 - DNA, 20 bp, Artificial sequence
  Synthetic oligonucleotide
ggacaggaatactattctga

SEQ ID NO: 1510 - DNA, 20 bp, Artificial sequence
  Synthetic oligonucleotide
gggtgaagcctccaatgtat

SEQ ID NO: 1511 - DNA, 20 bp, Artificial sequence
  Synthetic oligonucleotide
ccctcaacccaagttctggt

SEQ ID NO: 1512 - DNA, 20 bp, Artificial sequence
  Synthetic oligonucleotide
gcaagtacaatattttacac

SEQ ID NO: 1513 - DNA, 20 bp, Artificial sequence
  Synthetic oligonucleotide
cactgaaaaatatatgttca

SEQ ID NO: 1514 - DNA, 20 bp, Artificial sequence
  Synthetic oligonucleotide
cactataaaaacatctaaca

SEQ ID NO: 1515 - DNA, 20 bp, Artificial sequence
  Synthetic oligonucleotide
ttcaacaatatttatgccca

SEQ ID NO: 1516 - DNA, 20 bp, Artificial sequence
  Synthetic oligonucleotide
cagctaaaaacccaacatgg

SEQ ID NO: 1517 - DNA, 20 bp, Artificial sequence
  Synthetic oligonucleotide
agttatatattttagctgaa

SEQ ID NO: 1518 - DNA, 20 bp, Artificial sequence
  Synthetic oligonucleotide
gctatattttaaaaaggatc

SEQ ID NO: 1519 - DNA, 20 bp, Artificial sequence
  Synthetic oligonucleotide
ctttcatttcaaacttactg

SEQ ID NO: 1520 - DNA, 20 bp, Artificial sequence
  Synthetic oligonucleotide
actttcttttaaattctaac

SEQ ID NO: 1521 - DNA, 20 bp, Artificial sequence
  Synthetic oligonucleotide
gatggtaatttttagaggtg

SEQ ID NO: 1522 - DNA, 20 bp, Artificial sequence
  Synthetic oligonucleotide
tctttctatatttatctata

SEQ ID NO: 1523 - DNA, 20 bp, Artificial sequence
  Synthetic oligonucleotide
gtttacaaaatatttgcaca

SEQ ID NO: 1524 - DNA, 20 bp, Artificial sequence
  Synthetic oligonucleotide
tctatcaaacctaatctatc

SEQ ID NO: 1525 - DNA, 20 bp, Artificial sequence
  Synthetic oligonucleotide
aaggaatttctttacaccat

SEQ ID NO: 1526 - DNA, 20 bp, Artificial sequence
  Synthetic oligonucleotide
gcacttcgaatttataccac

SEQ ID NO: 1527 - DNA, 20 bp, Artificial sequence
  Synthetic oligonucleotide
aacataaaaaatatacctaa

SEQ ID NO: 1528 - DNA, 20 bp, Artificial sequence
  Synthetic oligonucleotide
gctgttaaaatatgctttcc

SEQ ID NO: 1529 - DNA, 20 bp, Artificial sequence
  Synthetic oligonucleotide
gggcactacccttatcttaa

SEQ ID NO: 1530 - DNA, 20 bp, Artificial sequence
  Synthetic oligonucleotide
cctgtcaaaaatataatacc

SEQ ID NO: 1531 - DNA, 20 bp, Artificial sequence
  Synthetic oligonucleotide
cctttaaaaatatgcctttt

SEQ ID NO: 1532 - DNA, 20 bp, Artificial sequence
  Synthetic oligonucleotide
ccaataaaaccccacagggt

SEQ ID NO: 1533 - DNA, 20 bp, Artificial sequence
  Synthetic oligonucleotide
ctttagcatctaatcccctc

SEQ ID NO: 1534 - DNA, 20 bp, Artificial sequence
  Synthetic oligonucleotide
aaacccgtttaccctgcctc

SEQ ID NO: 1535 - DNA, 20 bp, Artificial sequence
  Synthetic oligonucleotide
ggcctgacttttatatgcaa

SEQ ID NO: 1536 - DNA, 20 bp, Artificial sequence
  Synthetic oligonucleotide
gttttcaaatcctagatgga

SEQ ID NO: 1537 - DNA, 20 bp, Artificial sequence
  Synthetic oligonucleotide
gggcccttccaaagactgta

SEQ ID NO: 1538 - DNA, 20 bp, Artificial sequence
  Synthetic oligonucleotide
acctcttttcacacctgcct

SEQ ID NO: 1539 - DNA, 20 bp, Artificial sequence
  Synthetic oligonucleotide
cacagggaagccaatttctc

SEQ ID NO: 1540 - DNA, 20 bp, Artificial sequence
  Synthetic oligonucleotide
catctcttcttccacaactt

SEQ ID NO: 1541 - DNA, 20 bp, Artificial sequence
  Synthetic oligonucleotide
ctctcaagagattatctcct

SEQ ID NO: 1542 - DNA, 20 bp, Artificial sequence
  Synthetic oligonucleotide
ctttcctcccacagcaccta

SEQ ID NO: 1543 - DNA, 20 bp, Artificial sequence
  Synthetic oligonucleotide
gatttatttttcagctgtga

SEQ ID NO: 1544 - DNA, 20 bp, Artificial sequence
  Synthetic oligonucleotide
tgcacccctcaaatccagtt

SEQ ID NO: 1545 - DNA, 20 bp, Artificial sequence
  Synthetic oligonucleotide
ccatcggtagacagccagta

SEQ ID NO: 1546 - DNA, 20 bp, Artificial sequence
  Synthetic oligonucleotide
ggtacaaagacccacaaaca

SEQ ID NO: 1547 - DNA, 20 bp, Artificial sequence
  Synthetic oligonucleotide
aacataatattcagtgctaa

SEQ ID NO: 1548 - DNA, 20 bp, Artificial sequence
  Synthetic oligonucleotide
gagtgttctatttaaaacac

SEQ ID NO: 1549 - DNA, 20 bp, Artificial sequence
  Synthetic oligonucleotide
tcccagacatacaaatttcg

SEQ ID NO: 1550 - DNA, 20 bp, Artificial sequence
  Synthetic oligonucleotide
tagtcaataactactatatc

SEQ ID NO: 1551 - DNA, 20 bp, Artificial sequence
  Synthetic oligonucleotide
gccagcaagcccatgtgctc

SEQ ID NO: 1552 - DNA, 20 bp, Artificial sequence
  Synthetic oligonucleotide
cagtaccacagataaccaaa

SEQ ID NO: 1553 - DNA, 20 bp, Artificial sequence
  Synthetic oligonucleotide
gctcagttaaaatctgaaag

SEQ ID NO: 1554 - DNA, 20 bp, Artificial sequence
  Synthetic oligonucleotide
gtgggctcaagatatcttcc

SEQ ID NO: 1555 - DNA, 20 bp, Artificial sequence
  Synthetic oligonucleotide
agaatgatactattttttta

SEQ ID NO: 1556 - DNA, 20 bp, Artificial sequence
  Synthetic oligonucleotide
gcctcccaccaggagacaga

SEQ ID NO: 1557 - DNA, 20 bp, Artificial sequence
  Synthetic oligonucleotide
gatgtcatcttcaactggaa

SEQ ID NO: 1558 - DNA, 20 bp, Artificial sequence
  Synthetic oligonucleotide
ttctttggtgaaagttaaaa

SEQ ID NO: 1559 - DNA, 20 bp, Artificial sequence
  Synthetic oligonucleotide
ttcttctttaatcacttcaa

SEQ ID NO: 1560 - DNA, 20 bp, Artificial sequence
  Synthetic oligonucleotide
tctggctttcccaataaacc

SEQ ID NO: 1561 - DNA, 20 bp, Artificial sequence
  Synthetic oligonucleotide
aacaacaatcatgtactttt

SEQ ID NO: 1562 - DNA, 20 bp, Artificial sequence
  Synthetic oligonucleotide
acaagccctttataacaggt

SEQ ID NO: 1563 - DNA, 20 bp, Artificial sequence
  Synthetic oligonucleotide
ttgcccaacaccaggcagag

SEQ ID NO: 1564 - DNA, 20 bp, Artificial sequence
  Synthetic oligonucleotide
gtttcaaaactacatttaca

SEQ ID NO: 1565 - DNA, 20 bp, Artificial sequence
  Synthetic oligonucleotide
tcttccaattttgtaaattt

SEQ ID NO: 1566 - DNA, 20 bp, Artificial sequence
  Synthetic oligonucleotide
caccatcaacagatctgcat

SEQ ID NO: 1567 - DNA, 20 bp, Artificial sequence
  Synthetic oligonucleotide
aggcctagccccaaacagga

SEQ ID NO: 1568 - DNA, 20 bp, Artificial sequence
  Synthetic oligonucleotide
cagatcttaaaaaaggatgc

SEQ ID NO: 1569 - DNA, 20 bp, Artificial sequence
  Synthetic oligonucleotide
atcaggaaaagatgatggcc

SEQ ID NO: 1570 - DNA, 20 bp, Artificial sequence
  Synthetic oligonucleotide
agagcacccacttagctttc

SEQ ID NO: 1571 - DNA, 20 bp, Artificial sequence
  Synthetic oligonucleotide
aacctattccctgttgtaaa

SEQ ID NO: 1572 - DNA, 20 bp, Artificial sequence
  Synthetic oligonucleotide
acggcaaatcaaagagctgg

SEQ ID NO: 1573 - DNA, 20 bp, Artificial sequence
  Synthetic oligonucleotide
acagaaacctaaaattaaga

SEQ ID NO: 1574 - DNA, 20 bp, Artificial sequence
  Synthetic oligonucleotide
acccccaaccccccttaccc

SEQ ID NO: 1575 - DNA, 20 bp, Artificial sequence
  Synthetic oligonucleotide
cctttaaaccacattgaaac

SEQ ID NO: 1576 - DNA, 20 bp, Artificial sequence
  Synthetic oligonucleotide
gcaggaatatcacacaagtt

SEQ ID NO: 1577 - DNA, 20 bp, Artificial sequence
  Synthetic oligonucleotide
aactatgaaataccctttct

SEQ ID NO: 1578 - DNA, 20 bp, Artificial sequence
  Synthetic oligonucleotide
aaggaactattctagctatt

SEQ ID NO: 1579 - DNA, 20 bp, Artificial sequence
  Synthetic oligonucleotide
tagaaccacaaaaattatga

SEQ ID NO: 1580 - DNA, 20 bp, Artificial sequence
  Synthetic oligonucleotide
accgaagaatttctacccct

SEQ ID NO: 1581 - DNA, 20 bp, Artificial sequence
  Synthetic oligonucleotide
aacagaaatcaaatcatccc

SEQ ID NO: 1582 - DNA, 20 bp, Artificial sequence
  Synthetic oligonucleotide
aacaaaaataaattttggca

SEQ ID NO: 1583 - DNA, 20 bp, Artificial sequence
  Synthetic oligonucleotide
atgtgttcttaaattctcta

SEQ ID NO: 1584 - DNA, 20 bp, Artificial sequence
  Synthetic oligonucleotide
tgtactcctcaaagtgagtg

SEQ ID NO: 1585 - DNA, 20 bp, Artificial sequence
  Synthetic oligonucleotide
acagtattctcaaatcgcag

SEQ ID NO: 1586 - DNA, 20 bp, Artificial sequence
  Synthetic oligonucleotide
ctgtccagtttccactgtcc

SEQ ID NO: 1587 - DNA, 20 bp, Artificial sequence
  Synthetic oligonucleotide
cagcaaacaaactaaaggga

SEQ ID NO: 1588 - DNA, 20 bp, Artificial sequence
  Synthetic oligonucleotide
gccctcaacccaagttctgg

SEQ ID NO: 1589 - DNA, 20 bp, Artificial sequence
  Synthetic oligonucleotide
tatgaattcttccatttttt

SEQ ID NO: 1590 - DNA, 20 bp, Artificial sequence
  Synthetic oligonucleotide
aacattattcaaagaaatgt

SEQ ID NO: 1591 - DNA, 20 bp, Artificial sequence
  Synthetic oligonucleotide
aggcagaacatttaacatcg

SEQ ID NO: 1592 - DNA, 20 bp, Artificial sequence
  Synthetic oligonucleotide
tctgtgtttatttaggtttc

SEQ ID NO: 1593 - DNA, 20 bp, Artificial sequence
  Synthetic oligonucleotide
actgcatttcaaaacctaca

SEQ ID NO: 1594 - DNA, 20 bp, Artificial sequence
  Synthetic oligonucleotide
ttgaagttttaaagtacatg

SEQ ID NO: 1595 - DNA, 20 bp, Artificial sequence
  Synthetic oligonucleotide
atgtttaaaatatgcatgcc

SEQ ID NO: 1596 - DNA, 20 bp, Artificial sequence
  Synthetic oligonucleotide
tttctcagaatataactgta

SEQ ID NO: 1597 - DNA, 20 bp, Artificial sequence
  Synthetic oligonucleotide
gtgtaatttcaaaatagggt

SEQ ID NO: 1598 - DNA, 20 bp, Artificial sequence
  Synthetic oligonucleotide
agctttcaaatttatccact

SEQ ID NO: 1599 - DNA, 20 bp, Artificial sequence
  Synthetic oligonucleotide
acttagccaatttaactgca

SEQ ID NO: 1600 - DNA, 20 bp, Artificial sequence
  Synthetic oligonucleotide
tctttaaaactattagtcac

SEQ ID NO: 1601 - DNA, 20 bp, Artificial sequence
  Synthetic oligonucleotide
ctaatctatcaaacctaatc

SEQ ID NO: 1602 - DNA, 20 bp, Artificial sequence
  Synthetic oligonucleotide
tcagttaaaatacctgatga

SEQ ID NO: 1603 - DNA, 20 bp, Artificial sequence
  Synthetic oligonucleotide
ggttaatatttttatggtat

SEQ ID NO: 1604 - DNA, 20 bp, Artificial sequence
  Synthetic oligonucleotide
gttataatttaaaaagtgtt

SEQ ID NO: 1605 - DNA, 20 bp, Artificial sequence
  Synthetic oligonucleotide
ccgttttatttttaaactcg

SEQ ID NO: 1606 - DNA, 20 bp, Artificial sequence
  Synthetic oligonucleotide
gcttcattttaaaagattgt

SEQ ID NO: 1607 - DNA, 20 bp, Artificial sequence
  Synthetic oligonucleotide
ccacataaaatatcgaatca

SEQ ID NO: 1608 - DNA, 20 bp, Artificial sequence
  Synthetic oligonucleotide
cagggctgtatttaattctg

SEQ ID NO: 1609 - DNA, 20 bp, Artificial sequence
  Synthetic oligonucleotide
gttctcaatccttaatgatt

SEQ ID NO: 1610 - DNA, 20 bp, Artificial sequence
  Synthetic oligonucleotide
gacatattttaaaacatgga

SEQ ID NO: 1611 - DNA, 20 bp, Artificial sequence
  Synthetic oligonucleotide
aaccaatcctaaacccgttt

SEQ ID NO: 1612 - DNA, 20 bp, Artificial sequence
  Synthetic oligonucleotide
aggcctgacttttatatgca

SEQ ID NO: 1613 - DNA, 20 bp, Artificial sequence
  Synthetic oligonucleotide
tgttttcaaatcctagatgg

SEQ ID NO: 1614 - DNA, 20 bp, Artificial sequence
  Synthetic oligonucleotide
ttttaaataagatctttggg

SEQ ID NO: 1615 - DNA, 20 bp, Artificial sequence
  Synthetic oligonucleotide
aacctcttttcacacctgcc

SEQ ID NO: 1616 - DNA, 20 bp, Artificial sequence
  Synthetic oligonucleotide
agtagagagatttagtgatc

SEQ ID NO: 1617 - DNA, 20 bp, Artificial sequence
  Synthetic oligonucleotide
ggagaaaaccatctcttctt

SEQ ID NO: 1618 - DNA, 20 bp, Artificial sequence
  Synthetic oligonucleotide
gcattaaaaaacggaaccct

SEQ ID NO: 1619 - DNA, 20 bp, Artificial sequence
  Synthetic oligonucleotide
ttcccctttcctcccacagc

SEQ ID NO: 1620 - DNA, 20 bp, Artificial sequence
  Synthetic oligonucleotide
tgatttatttttcagctgtg

SEQ ID NO: 1621 - DNA, 20 bp, Artificial sequence
  Synthetic oligonucleotide
aatgcacccctcaaatccag

SEQ ID NO: 1622 - DNA, 20 bp, Artificial sequence
  Synthetic oligonucleotide
agtcaaccaaaaaatagtag

SEQ ID NO: 1623 - DNA, 20 bp, Artificial sequence
  Synthetic oligonucleotide
agagaggtacaaagacccac

SEQ ID NO: 1624 - DNA, 20 bp, Artificial sequence
  Synthetic oligonucleotide
aacaacataatattcagtgc

SEQ ID NO: 1625 - DNA, 20 bp, Artificial sequence
  Synthetic oligonucleotide
tgagtgtaagaatctctgtg

SEQ ID NO: 1626 - DNA, 20 bp, Artificial sequence
  Synthetic oligonucleotide
acactatcccagacatacaa

SEQ ID NO: 1627 - DNA, 20 bp, Artificial sequence
  Synthetic oligonucleotide
ccacttagtcaataactact

SEQ ID NO: 1628 - DNA, 20 bp, Artificial sequence
  Synthetic oligonucleotide
tgccagcaagcccatgtgct

SEQ ID NO: 1629 - DNA, 20 bp, Artificial sequence
  Synthetic oligonucleotide
gagcagtaccacagataacc

SEQ ID NO: 1630 - DNA, 20 bp, Artificial sequence
  Synthetic oligonucleotide
tgctcagttaaaatctgaaa

SEQ ID NO: 1631 - DNA, 20 bp, Artificial sequence
  Synthetic oligonucleotide
ctctagtttccatagcttcc

SEQ ID NO: 1632 - DNA, 20 bp, Artificial sequence
  Synthetic oligonucleotide
ttccaaatacacctagaatg

SEQ ID NO: 1633 - DNA, 20 bp, Artificial sequence
  Synthetic oligonucleotide
cttgcctcccaccaggagac

SEQ ID NO: 1634 - DNA, 20 bp, Artificial sequence
  Synthetic oligonucleotide
tgatgtcatcttcaactgga

SEQ ID NO: 1635 - DNA, 20 bp, Artificial sequence
  Synthetic oligonucleotide
ggtttttttcccttctttgg

SEQ ID NO: 1636 - DNA, 20 bp, Artificial sequence
  Synthetic oligonucleotide
gattcttctttaatcacttc

SEQ ID NO: 1637 - DNA, 20 bp, Artificial sequence
  Synthetic oligonucleotide
ctcatcatcttctcaatttc

SEQ ID NO: 1638 - DNA, 20 bp, Artificial sequence
  Synthetic oligonucleotide
cacaaacaacaatcatgtac

SEQ ID NO: 1639 - DNA, 20 bp, Artificial sequence
  Synthetic oligonucleotide
ctacaagccctttataacag

SEQ ID NO: 1640 - DNA, 20 bp, Artificial sequence
  Synthetic oligonucleotide
tattcttgcccaacaccagg

SEQ ID NO: 1641 - DNA, 20 bp, Artificial sequence
  Synthetic oligonucleotide
ggtttcaaaactacatttac

SEQ ID NO: 1642 - DNA, 20 bp, Artificial sequence
  Synthetic oligonucleotide
tctcaggtacaaactttaca

SEQ ID NO: 1643 - DNA, 20 bp, Artificial sequence
  Synthetic oligonucleotide
ttcaccatcaacagatctgc

SEQ ID NO: 1644 - DNA, 20 bp, Artificial sequence
  Synthetic oligonucleotide
agacagtttcaagaaggcct

SEQ ID NO: 1645 - DNA, 20 bp, Artificial sequence
  Synthetic oligonucleotide
tcagatcttaaaaaaggatg

SEQ ID NO: 1646 - DNA, 20 bp, Artificial sequence
  Synthetic oligonucleotide
aagatagtaaaaaggccagg

SEQ ID NO: 1647 - DNA, 20 bp, Artificial sequence
  Synthetic oligonucleotide
atcgaaccccagtaatgaca

SEQ ID NO: 1648 - DNA, 20 bp, Artificial sequence
  Synthetic oligonucleotide
ttgtgtaaacctattccctg

SEQ ID NO: 1649 - DNA, 20 bp, Artificial sequence
  Synthetic oligonucleotide
acacggcaaatcaaagagct

SEQ ID NO: 1650 - DNA, 20 bp, Artificial sequence
  Synthetic oligonucleotide
aaggttagaacagaaaccta

SEQ ID NO: 1651 - DNA, 20 bp, Artificial sequence
  Synthetic oligonucleotide
cacccccaaccccccttacc

SEQ ID NO: 1652 - DNA, 20 bp, Artificial sequence
  Synthetic oligonucleotide
ccctttaaaccacattgaaa

SEQ ID NO: 1653 - DNA, 20 bp, Artificial sequence
  Synthetic oligonucleotide
ccccaaacctttcccacaat

SEQ ID NO: 1654 - DNA, 20 bp, Artificial sequence
  Synthetic oligonucleotide
atgatatttcggatctctgg

SEQ ID NO: 1655 - DNA, 20 bp, Artificial sequence
  Synthetic oligonucleotide
gtcaaggaactattctagct

SEQ ID NO: 1656 - DNA, 20 bp, Artificial sequence
  Synthetic oligonucleotide
attcctatacctgaaataga

SEQ ID NO: 1657 - DNA, 20 bp, Artificial sequence
  Synthetic oligonucleotide
caccgaagaatttctacccc

SEQ ID NO: 1658 - DNA, 20 bp, Artificial sequence
  Synthetic oligonucleotide
ctcacaattccaagttagaa

SEQ ID NO: 1659 - DNA, 20 bp, Artificial sequence
  Synthetic oligonucleotide
agtagtcacagatgttaaag

SEQ ID NO: 1660 - DNA, 20 bp, Artificial sequence
  Synthetic oligonucleotide
gatgtgttcttaaattctct

SEQ ID NO: 1661 - DNA, 20 bp, Artificial sequence
  Synthetic oligonucleotide
acctgtactcctcaaagtga

SEQ ID NO: 1662 - DNA, 20 bp, Artificial sequence
  Synthetic oligonucleotide
aacagtattctcaaatcgca

SEQ ID NO: 1663 - DNA, 20 bp, Artificial sequence
  Synthetic oligonucleotide
cttaatatccccacagctgt

SEQ ID NO: 1664 - DNA, 20 bp, Artificial sequence
  Synthetic oligonucleotide
ttggccatccagacagcaaa

SEQ ID NO: 1665 - DNA, 20 bp, Artificial sequence
  Synthetic oligonucleotide
tgccctcaacccaagttctg

SEQ ID NO: 1666 - DNA, 20 bp, Artificial sequence
  Synthetic oligonucleotide
atatgaattcttccattttt

SEQ ID NO: 1667 - DNA, 20 bp, Artificial sequence
  Synthetic oligonucleotide
cgttataaaatatattacta

SEQ ID NO: 1668 - DNA, 20 bp, Artificial sequence
  Synthetic oligonucleotide
gcaagatgaatttatcctcc

SEQ ID NO: 1669 - DNA, 20 bp, Artificial sequence
  Synthetic oligonucleotide
cacaacttattttaatgtca

SEQ ID NO: 1670 - DNA, 20 bp, Artificial sequence
  Synthetic oligonucleotide
tgagtattttaaactcttct

SEQ ID NO: 1671 - DNA, 20 bp, Artificial sequence
  Synthetic oligonucleotide
attccattattttagaaagc

SEQ ID NO: 1672 - DNA, 20 bp, Artificial sequence
  Synthetic oligonucleotide
acttgcaaaatttcaagttt

SEQ ID NO: 1673 - DNA, 20 bp, Artificial sequence
  Synthetic oligonucleotide
agcaagttaatttatggcca

SEQ ID NO: 1674 - DNA, 20 bp, Artificial sequence
  Synthetic oligonucleotide
gattgaatcatttacctcgc

SEQ ID NO: 1675 - DNA, 20 bp, Artificial sequence
  Synthetic oligonucleotide
atctgctttctttattccct

SEQ ID NO: 1676 - DNA, 20 bp, Artificial sequence
  Synthetic oligonucleotide
atctctgttatttaacactg

SEQ ID NO: 1677 - DNA, 20 bp, Artificial sequence
  Synthetic oligonucleotide
ttctttaaaactattagtca

SEQ ID NO: 1678 - DNA, 20 bp, Artificial sequence
  Synthetic oligonucleotide
gacctcaaaaccaaattagg

SEQ ID NO: 1679 - DNA, 20 bp, Artificial sequence
  Synthetic oligonucleotide
tctgaaattcaaaatcagtg

SEQ ID NO: 1680 - DNA, 20 bp, Artificial sequence
  Synthetic oligonucleotide
ccactggaaatttaacatga

SEQ ID NO: 1681 - DNA, 20 bp, Artificial sequence
  Synthetic oligonucleotide
tgtatcacccattaactgac

SEQ ID NO: 1682 - DNA, 20 bp, Artificial sequence
  Synthetic oligonucleotide
gactaaaaaatatacatctc

SEQ ID NO: 1683 - DNA, 20 bp, Artificial sequence
  Synthetic oligonucleotide
ggtctatttctttacagcac

SEQ ID NO: 1684 - DNA, 20 bp, Artificial sequence
  Synthetic oligonucleotide
ttcttctgtatttaattctt

SEQ ID NO: 1685 - DNA, 20 bp, Artificial sequence
  Synthetic oligonucleotide
actgagtttcaaagcaaaga

SEQ ID NO: 1686 - DNA, 20 bp, Artificial sequence
  Synthetic oligonucleotide
atccgattttaaaacaaaca

SEQ ID NO: 1687 - DNA, 20 bp, Artificial sequence
  Synthetic oligonucleotide
agacatattttaaaacatgg

SEQ ID NO: 1688 - DNA, 20 bp, Artificial sequence
  Synthetic oligonucleotide
taaccaatcctaaacccgtt

SEQ ID NO: 1689 - DNA, 20 bp, Artificial sequence
  Synthetic oligonucleotide
attagctaattcctagaggc

SEQ ID NO: 1690 - DNA, 20 bp, Artificial sequence
  Synthetic oligonucleotide
tgaatgttttcaaatcctag

SEQ ID NO: 1691 - DNA, 20 bp, Artificial sequence
  Synthetic oligonucleotide
ccatttattttaaaaatcct

SEQ ID NO: 1692 - DNA, 20 bp, Artificial sequence
  Synthetic oligonucleotide
catttctaaacaaaacctct

SEQ ID NO: 1693 - DNA, 20 bp, Artificial sequence
  Synthetic oligonucleotide
cagtagagagatttagtgat

SEQ ID NO: 1694 - DNA, 20 bp, Artificial sequence
  Synthetic oligonucleotide
tggagaaaaccatctcttct

SEQ ID NO: 1695 - DNA, 20 bp, Artificial sequence
  Synthetic oligonucleotide
gtgaagcattaaaaaacgga

SEQ ID NO: 1696 - DNA, 20 bp, Artificial sequence
  Synthetic oligonucleotide
ctggcattcccctttcctcc

SEQ ID NO: 1697 - DNA, 20 bp, Artificial sequence
  Synthetic oligonucleotide
ttgatttatttttcagctgt

SEQ ID NO: 1698 - DNA, 20 bp, Artificial sequence
  Synthetic oligonucleotide
ccaatgcacccctcaaatcc

SEQ ID NO: 1699 - DNA, 20 bp, Artificial sequence
  Synthetic oligonucleotide
ccgatgactcacagctcaca

SEQ ID NO: 1700 - DNA, 20 bp, Artificial sequence
  Synthetic oligonucleotide
gagagcatttttctcctttt

SEQ ID NO: 1701 - DNA, 20 bp, Artificial sequence
  Synthetic oligonucleotide
gaacaacataatattcagtg

SEQ ID NO: 1702 - DNA, 20 bp, Artificial sequence
  Synthetic oligonucleotide
tcattaataaaaacagtcaa

SEQ ID NO: 1703 - DNA, 20 bp, Artificial sequence
  Synthetic oligonucleotide
tgacactatcccagacatac

SEQ ID NO: 1704 - DNA, 20 bp, Artificial sequence
  Synthetic oligonucleotide
caccacttagtcaataacta

SEQ ID NO: 1705 - DNA, 20 bp, Artificial sequence
  Synthetic oligonucleotide
ccaccctcctccactctttc

SEQ ID NO: 1706 - DNA, 20 bp, Artificial sequence
  Synthetic oligonucleotide
gggagcagtaccacagataa

SEQ ID NO: 1707 - DNA, 20 bp, Artificial sequence
  Synthetic oligonucleotide
gtgctcagttaaaatctgaa

SEQ ID NO: 1708 - DNA, 20 bp, Artificial sequence
  Synthetic oligonucleotide
ccctctagtttccatagctt

SEQ ID NO: 1709 - DNA, 20 bp, Artificial sequence
  Synthetic oligonucleotide
cttttccaaatacacctaga

SEQ ID NO: 1710 - DNA, 20 bp, Artificial sequence
  Synthetic oligonucleotide
ttggttaagacctagtttct

SEQ ID NO: 1711 - DNA, 20 bp, Artificial sequence
  Synthetic oligonucleotide
tggatgtgaaacagagacgg

SEQ ID NO: 1712 - DNA, 20 bp, Artificial sequence
  Synthetic oligonucleotide
ataaggtttttttcccttct

SEQ ID NO: 1713 - DNA, 20 bp, Artificial sequence
  Synthetic oligonucleotide
agattcttctttaatcactt

SEQ ID NO: 1714 - DNA, 20 bp, Artificial sequence
  Synthetic oligonucleotide
gagatggtactttagaaggc

SEQ ID NO: 1715 - DNA, 20 bp, Artificial sequence
  Synthetic oligonucleotide
acacaaacaacaatcatgta

SEQ ID NO: 1716 - DNA, 20 bp, Artificial sequence
  Synthetic oligonucleotide
tgtctacaagccctttataa

SEQ ID NO: 1717 - DNA, 20 bp, Artificial sequence
  Synthetic oligonucleotide
tgcttattcttgcccaacac

SEQ ID NO: 1718 - DNA, 20 bp, Artificial sequence
  Synthetic oligonucleotide
tggtttcaaaactacattta

SEQ ID NO: 1719 - DNA, 20 bp, Artificial sequence
  Synthetic oligonucleotide
ggctatttttataatgtgaa

SEQ ID NO: 1720 - DNA, 20 bp, Artificial sequence
  Synthetic oligonucleotide
acagtaattaaaagaattca

SEQ ID NO: 1721 - DNA, 20 bp, Artificial sequence
  Synthetic oligonucleotide
cagaagttaatacttgagga

SEQ ID NO: 1722 - DNA, 20 bp, Artificial sequence
  Synthetic oligonucleotide
gcaaaatatcagatcttaaa

SEQ ID NO: 1723 - DNA, 20 bp, Artificial sequence
  Synthetic oligonucleotide
ggacagcaaataagatagta

SEQ ID NO: 1724 - DNA, 20 bp, Artificial sequence
  Synthetic oligonucleotide
ccagtcaatcgaaccccagt

SEQ ID NO: 1725 - DNA, 20 bp, Artificial sequence
  Synthetic oligonucleotide
tttgtgtaaacctattccct

SEQ ID NO: 1726 - DNA, 20 bp, Artificial sequence
  Synthetic oligonucleotide
gcagacatccccaactgaga

SEQ ID NO: 1727 - DNA, 20 bp, Artificial sequence
  Synthetic oligonucleotide
ctcctgcgacacacctgctg

SEQ ID NO: 1728 - DNA, 20 bp, Artificial sequence
  Synthetic oligonucleotide
attggttttcctaacactgc

SEQ ID NO: 1729 - DNA, 20 bp, Artificial sequence
  Synthetic oligonucleotide
tccctttaaaccacattgaa

SEQ ID NO: 1730 - DNA, 20 bp, Artificial sequence
  Synthetic oligonucleotide
cccccaaacctttcccacaa

SEQ ID NO: 1731 - DNA, 20 bp, Artificial sequence
  Synthetic oligonucleotide
cccacaaatgatatttcgga

SEQ ID NO: 1732 - DNA, 20 bp, Artificial sequence
  Synthetic oligonucleotide
ggtaatgaaattcgaggaaa

SEQ ID NO: 1733 - DNA, 20 bp, Artificial sequence
  Synthetic oligonucleotide
ttttataattcctatacctg

SEQ ID NO: 1734 - DNA, 20 bp, Artificial sequence
  Synthetic oligonucleotide
ggcaccgaagaatttctacc

SEQ ID NO: 1735 - DNA, 20 bp, Artificial sequence
  Synthetic oligonucleotide
gctcacaattccaagttaga

SEQ ID NO: 1736 - DNA, 20 bp, Artificial sequence
  Synthetic oligonucleotide
cttagtagtcacagatgtta

SEQ ID NO: 1737 - DNA, 20 bp, Artificial sequence
  Synthetic oligonucleotide
tatatttattacttgatgtg

SEQ ID NO: 1738 - DNA, 20 bp, Artificial sequence
  Synthetic oligonucleotide
attttttaaaacattacctg

SEQ ID NO: 1739 - DNA, 20 bp, Artificial sequence
  Synthetic oligonucleotide
agaagtactttcagcatagg

SEQ ID NO: 1740 - DNA, 20 bp, Artificial sequence
  Synthetic oligonucleotide
gcttaatatccccacagctg

SEQ ID NO: 1741 - DNA, 20 bp, Artificial sequence
  Synthetic oligonucleotide
ttggccacagaaaaggagac

SEQ ID NO: 1742 - DNA, 20 bp, Artificial sequence
  Synthetic oligonucleotide
tggtagtgccctcaacccaa

SEQ ID NO: 1743 - DNA, 20 bp, Artificial sequence
  Synthetic oligonucleotide
ccacgattagaaaatagaat

SEQ ID NO: 1744 - DNA, 20 bp, Artificial sequence
  Synthetic oligonucleotide
tcaaacaaaatataatgctt

SEQ ID NO: 1745 - DNA, 20 bp, Artificial sequence
  Synthetic oligonucleotide
ctacacaaaaccaatcactt

SEQ ID NO: 1746 - DNA, 20 bp, Artificial sequence
  Synthetic oligonucleotide
cgccttaatttttattatag

SEQ ID NO: 1747 - DNA, 20 bp, Artificial sequence
  Synthetic oligonucleotide
ccatttagaatatagctgtt

SEQ ID NO: 1748 - DNA, 20 bp, Artificial sequence
  Synthetic oligonucleotide
attctcatccattatacttt

SEQ ID NO: 1749 - DNA, 20 bp, Artificial sequence
  Synthetic oligonucleotide
ttaccaaaaaccatttgtgt

SEQ ID NO: 1750 - DNA, 20 bp, Artificial sequence
  Synthetic oligonucleotide
tccttctttcaaagttcacc

SEQ ID NO: 1751 - DNA, 20 bp, Artificial sequence
  Synthetic oligonucleotide
ctgccactattttatgtctg

SEQ ID NO: 1752 - DNA, 20 bp, Artificial sequence
  Synthetic oligonucleotide
cccaggttcccttatcatct

SEQ ID NO: 1753 - DNA, 20 bp, Artificial sequence
  Synthetic oligonucleotide
ttctgcaaataattccgtca

SEQ ID NO: 1754 - DNA, 20 bp, Artificial sequence
  Synthetic oligonucleotide
ccatcatttctttaaaacta

SEQ ID NO: 1755 - DNA, 20 bp, Artificial sequence
  Synthetic oligonucleotide
aagtacatacaaatacatat

SEQ ID NO: 1756 - DNA, 20 bp, Artificial sequence
  Synthetic oligonucleotide
cctatcaaagccacaacttc

SEQ ID NO: 1757 - DNA, 20 bp, Artificial sequence
  Synthetic oligonucleotide
ttgtataccatttatgtttc

SEQ ID NO: 1758 - DNA, 20 bp, Artificial sequence
  Synthetic oligonucleotide
ccactcaaacctttcaatgc

SEQ ID NO: 1759 - DNA, 20 bp, Artificial sequence
  Synthetic oligonucleotide
gagctcaaacccaagtctgt

SEQ ID NO: 1760 - DNA, 20 bp, Artificial sequence
  Synthetic oligonucleotide
accctatttccttaatgtaa

SEQ ID NO: 1761 - DNA, 20 bp, Artificial sequence
  Synthetic oligonucleotide
ctccttcacccttaaggcta

SEQ ID NO: 1762 - DNA, 20 bp, Artificial sequence
  Synthetic oligonucleotide
atcgagtccttttaaacaaa

SEQ ID NO: 1763 - DNA, 20 bp, Artificial sequence
  Synthetic oligonucleotide
acaactcgccattaacacta

SEQ ID NO: 1764 - DNA, 20 bp, Artificial sequence
  Synthetic oligonucleotide
agctaataagacatatttta

SEQ ID NO: 1765 - DNA, 20 bp, Artificial sequence
  Synthetic oligonucleotide
ctaaccaatcctaaacccgt

SEQ ID NO: 1766 - DNA, 20 bp, Artificial sequence
  Synthetic oligonucleotide
gattagctaattcctagagg

SEQ ID NO: 1767 - DNA, 20 bp, Artificial sequence
  Synthetic oligonucleotide
ttgaatgttttcaaatccta

SEQ ID NO: 1768 - DNA, 20 bp, Artificial sequence
  Synthetic oligonucleotide
gccatttattttaaaaatcc

SEQ ID NO: 1769 - DNA, 20 bp, Artificial sequence
  Synthetic oligonucleotide
gcatttctaaacaaaacctc

SEQ ID NO: 1770 - DNA, 20 bp, Artificial sequence
  Synthetic oligonucleotide
tgaggaagcccttcccggca

SEQ ID NO: 1771 - DNA, 20 bp, Artificial sequence
  Synthetic oligonucleotide
ttggagaaaaccatctcttc

SEQ ID NO: 1772 - DNA, 20 bp, Artificial sequence
  Synthetic oligonucleotide
ggaaagtataaaagtgaagc

SEQ ID NO: 1773 - DNA, 20 bp, Artificial sequence
  Synthetic oligonucleotide
gcacgcagtaacaatggaca

SEQ ID NO: 1774 - DNA, 20 bp, Artificial sequence
  Synthetic oligonucleotide
ctttgatttatttttcagct

SEQ ID NO: 1775 - DNA, 20 bp, Artificial sequence
  Synthetic oligonucleotide
cccttgtttctgcattggtt

SEQ ID NO: 1776 - DNA, 20 bp, Artificial sequence
  Synthetic oligonucleotide
tgttaccaccgatgactcac

SEQ ID NO: 1777 - DNA, 20 bp, Artificial sequence
  Synthetic oligonucleotide
gcacatacagtttaaaggag

SEQ ID NO: 1778 - DNA, 20 bp, Artificial sequence
  Synthetic oligonucleotide
ggtccctgttcctagggagg

SEQ ID NO: 1779 - DNA, 20 bp, Artificial sequence
  Synthetic oligonucleotide
gcaatgtttaaaaatcatta

SEQ ID NO: 1780 - DNA, 20 bp, Artificial sequence
  Synthetic oligonucleotide
ttcatgacactatcccagac

SEQ ID NO: 1781 - DNA, 20 bp, Artificial sequence
  Synthetic oligonucleotide
cctttcaccacttagtcaat

SEQ ID NO: 1782 - DNA, 20 bp, Artificial sequence
  Synthetic oligonucleotide
gcctcccaccctcctccact

SEQ ID NO: 1783 - DNA, 20 bp, Artificial sequence
  Synthetic oligonucleotide
atgaaaataaactcatggga

SEQ ID NO: 1784 - DNA, 20 bp, Artificial sequence
  Synthetic oligonucleotide
gtctaaaagacttcctagca

SEQ ID NO: 1785 - DNA, 20 bp, Artificial sequence
  Synthetic oligonucleotide
tctatttaaaataacaaccc

SEQ ID NO: 1786 - DNA, 20 bp, Artificial sequence
  Synthetic oligonucleotide
ttccttttccaaatacacct

SEQ ID NO: 1787 - DNA, 20 bp, Artificial sequence
  Synthetic oligonucleotide
tagaagagtatctattggtt

SEQ ID NO: 1788 - DNA, 20 bp, Artificial sequence
  Synthetic oligonucleotide
catctcaaaacatgctgtca

SEQ ID NO: 1789 - DNA, 20 bp, Artificial sequence
  Synthetic oligonucleotide
gagaagtaaaataaggtttt

SEQ ID NO: 1790 - DNA, 20 bp, Artificial sequence
  Synthetic oligonucleotide
gagattcttctttaatcact

SEQ ID NO: 1791 - DNA, 20 bp, Artificial sequence
  Synthetic oligonucleotide
ggagattttacttaattttt

SEQ ID NO: 1792 - DNA, 20 bp, Artificial sequence
  Synthetic oligonucleotide
tacacaaacaacaatcatgt

SEQ ID NO: 1793 - DNA, 20 bp, Artificial sequence
  Synthetic oligonucleotide
ctcattaagaaatgtctaca

SEQ ID NO: 1794 - DNA, 20 bp, Artificial sequence
  Synthetic oligonucleotide
gactctctaccagagttgcg

SEQ ID NO: 1795 - DNA, 20 bp, Artificial sequence
  Synthetic oligonucleotide
atttggtttcaaaactacat

SEQ ID NO: 1796 - DNA, 20 bp, Artificial sequence
  Synthetic oligonucleotide
gggctatttttataatgtga

SEQ ID NO: 1797 - DNA, 20 bp, Artificial sequence
  Synthetic oligonucleotide
gttcagacaaacagtaatta

SEQ ID NO: 1798 - DNA, 20 bp, Artificial sequence
  Synthetic oligonucleotide
acataatttgaatcctagga

SEQ ID NO: 1799 - DNA, 20 bp, Artificial sequence
  Synthetic oligonucleotide
tagcaaaatatcagatctta

SEQ ID NO: 1800 - DNA, 20 bp, Artificial sequence
  Synthetic oligonucleotide
ctggacagcaaataagatag

SEQ ID NO: 1801 - DNA, 20 bp, Artificial sequence
  Synthetic oligonucleotide
tgttagaaccagtcaatcga

SEQ ID NO: 1802 - DNA, 20 bp, Artificial sequence
  Synthetic oligonucleotide
tagtccagccctgtggacaa

SEQ ID NO: 1803 - DNA, 20 bp, Artificial sequence
  Synthetic oligonucleotide
tgcagacatccccaactgag

SEQ ID NO: 1804 - DNA, 20 bp, Artificial sequence
  Synthetic oligonucleotide
catatgcaccagtctcctgc

SEQ ID NO: 1805 - DNA, 20 bp, Artificial sequence
  Synthetic oligonucleotide
tgcaataacctgattggttt

SEQ ID NO: 1806 - DNA, 20 bp, Artificial sequence
  Synthetic oligonucleotide
tcatccctttaaaccacatt

SEQ ID NO: 1807 - DNA, 20 bp, Artificial sequence
  Synthetic oligonucleotide
tcccccaaacctttcccaca

SEQ ID NO: 1808 - DNA, 20 bp, Artificial sequence
  Synthetic oligonucleotide
ttcaaaacccacaaatgata

SEQ ID NO: 1809 - DNA, 20 bp, Artificial sequence
  Synthetic oligonucleotide
agggtaatgaaattcgagga

SEQ ID NO: 1810 - DNA, 20 bp, Artificial sequence
  Synthetic oligonucleotide
tattttataattcctatacc

SEQ ID NO: 1811 - DNA, 20 bp, Artificial sequence
  Synthetic oligonucleotide
ggacatagtacagaggcaca

SEQ ID NO: 1812 - DNA, 20 bp, Artificial sequence
  Synthetic oligonucleotide
ggctcacaattccaagttag

SEQ ID NO: 1813 - DNA, 20 bp, Artificial sequence
  Synthetic oligonucleotide
aataggtttccttagtagtc

SEQ ID NO: 1814 - DNA, 20 bp, Artificial sequence
  Synthetic oligonucleotide
tgtatatttattacttgatg

SEQ ID NO: 1815 - DNA, 20 bp, Artificial sequence
  Synthetic oligonucleotide
gtgcaattttttaaaacatt

SEQ ID NO: 1816 - DNA, 20 bp, Artificial sequence
  Synthetic oligonucleotide
gcaatggcttaagagtttag

SEQ ID NO: 1817 - DNA, 20 bp, Artificial sequence
  Synthetic oligonucleotide
tgcttaatatccccacagct

SEQ ID NO: 1818 - DNA, 20 bp, Artificial sequence
  Synthetic oligonucleotide
aaggccttcagattggccac

SEQ ID NO: 1819 - DNA, 20 bp, Artificial sequence
  Synthetic oligonucleotide
tctggtagtgccctcaaccc

SEQ ID NO: 1820 - DNA, 20 bp, Artificial sequence
  Synthetic oligonucleotide
tagacacaccacgattagaa

SEQ ID NO: 1821 - DNA, 20 bp, Artificial sequence
  Synthetic oligonucleotide
actcaatatttttaaaaccc

SEQ ID NO: 1822 - DNA, 20 bp, Artificial sequence
  Synthetic oligonucleotide
gactgaattatttatagttg

SEQ ID NO: 1823 - DNA, 20 bp, Artificial sequence
  Synthetic oligonucleotide
atgcaattttaaattcatgt

SEQ ID NO: 1824 - DNA, 20 bp, Artificial sequence
  Synthetic oligonucleotide
gggaaaattccttagcatat

SEQ ID NO: 1825 - DNA, 20 bp, Artificial sequence
  Synthetic oligonucleotide
gctgagttccaaagcaaatt

SEQ ID NO: 1826 - DNA, 20 bp, Artificial sequence
  Synthetic oligonucleotide
atgacttaccaaaaaccatt

SEQ ID NO: 1827 - DNA, 20 bp, Artificial sequence
  Synthetic oligonucleotide
agggcttaaatttaactgaa

SEQ ID NO: 1828 - DNA, 20 bp, Artificial sequence
  Synthetic oligonucleotide
aacgaaattccttaaggaca

SEQ ID NO: 1829 - DNA, 20 bp, Artificial sequence
  Synthetic oligonucleotide
ttggttctattttataatag

SEQ ID NO: 1830 - DNA, 20 bp, Artificial sequence
  Synthetic oligonucleotide
agactactattttatcactg

SEQ ID NO: 1831 - DNA, 20 bp, Artificial sequence
  Synthetic oligonucleotide
tcacttaaacccaggtcagc

SEQ ID NO: 1832 - DNA, 20 bp, Artificial sequence
  Synthetic oligonucleotide
ttccccaaaatttagttgtg

SEQ ID NO: 1833 - DNA, 20 bp, Artificial sequence
  Synthetic oligonucleotide
cttcaactattttatttggc

SEQ ID NO: 1834 - DNA, 20 bp, Artificial sequence
  Synthetic oligonucleotide
agtagaatttaaaagtagaa

SEQ ID NO: 1835 - DNA, 20 bp, Artificial sequence
  Synthetic oligonucleotide
ggatttctaatttaatcttt

SEQ ID NO: 1836 - DNA, 20 bp, Artificial sequence
  Synthetic oligonucleotide
tagttctttcaaactccttt

SEQ ID NO: 1837 - DNA, 20 bp, Artificial sequence
  Synthetic oligonucleotide
gctataattcaaaatgctct

SEQ ID NO: 1838 - DNA, 20 bp, Artificial sequence
  Synthetic oligonucleotide
gcctaaacaatttattcatt

SEQ ID NO: 1839 - DNA, 20 bp, Artificial sequence
  Synthetic oligonucleotide
acccttctattttataaagc

SEQ ID NO: 1840 - DNA, 20 bp, Artificial sequence
  Synthetic oligonucleotide
tgcaagtttcaaaagaattc

SEQ ID NO: 1841 - DNA, 20 bp, Artificial sequence
  Synthetic oligonucleotide
aaggcatataccactgtacc

SEQ ID NO: 1842 - DNA, 20 bp, Artificial sequence
  Synthetic oligonucleotide
tctaaccaatcctaaacccg

SEQ ID NO: 1843 - DNA, 20 bp, Artificial sequence
  Synthetic oligonucleotide
agaggtatagtctctcctag

SEQ ID NO: 1844 - DNA, 20 bp, Artificial sequence
  Synthetic oligonucleotide
tgactattttcaactcaagc

SEQ ID NO: 1845 - DNA, 20 bp, Artificial sequence
  Synthetic oligonucleotide
tattattatgccatttattt

SEQ ID NO: 1846 - DNA, 20 bp, Artificial sequence
  Synthetic oligonucleotide
tcgcatttctaaacaaaacc

SEQ ID NO: 1847 - DNA, 20 bp, Artificial sequence
  Synthetic oligonucleotide
tttgaggaagcccttcccgg

SEQ ID NO: 1848 - DNA, 20 bp, Artificial sequence
  Synthetic oligonucleotide
gttttggagaaaaccatctc

SEQ ID NO: 1849 - DNA, 20 bp, Artificial sequence
  Synthetic oligonucleotide
ctaataaatttttacaaggg

SEQ ID NO: 1850 - DNA, 20 bp, Artificial sequence
  Synthetic oligonucleotide
aaggaggcttcctttggtgc

SEQ ID NO: 1851 - DNA, 20 bp, Artificial sequence
  Synthetic oligonucleotide
aggcctttgatttatttttc

SEQ ID NO: 1852 - DNA, 20 bp, Artificial sequence
  Synthetic oligonucleotide
gatggaagccaaaggctccc

SEQ ID NO: 1853 - DNA, 20 bp, Artificial sequence
  Synthetic oligonucleotide
aatgttaccaccgatgactc

SEQ ID NO: 1854 - DNA, 20 bp, Artificial sequence
  Synthetic oligonucleotide
tctgagagaatcaaaacata

SEQ ID NO: 1855 - DNA, 20 bp, Artificial sequence
  Synthetic oligonucleotide
ctcacttgccttccttttct

SEQ ID NO: 1856 - DNA, 20 bp, Artificial sequence
  Synthetic oligonucleotide
tgcaatgtttaaaaatcatt

SEQ ID NO: 1857 - DNA, 20 bp, Artificial sequence
  Synthetic oligonucleotide
aacattttttcatgacacta

SEQ ID NO: 1858 - DNA, 20 bp, Artificial sequence
  Synthetic oligonucleotide
tcctttcaccacttagtcaa

SEQ ID NO: 1859 - DNA, 20 bp, Artificial sequence
  Synthetic oligonucleotide
tctgtctttcatctctggat

SEQ ID NO: 1860 - DNA, 20 bp, Artificial sequence
  Synthetic oligonucleotide
ccaatgaaaataaactcatg

SEQ ID NO: 1861 - DNA, 20 bp, Artificial sequence
  Synthetic oligonucleotide
ccagagtctaaaagacttcc

SEQ ID NO: 1862 - DNA, 20 bp, Artificial sequence
  Synthetic oligonucleotide
ttctatttaaaataacaacc

SEQ ID NO: 1863 - DNA, 20 bp, Artificial sequence
  Synthetic oligonucleotide
gtatgggttccttttccaaa

SEQ ID NO: 1864 - DNA, 20 bp, Artificial sequence
  Synthetic oligonucleotide
agttttaataaaagttcaac

SEQ ID NO: 1865 - DNA, 20 bp, Artificial sequence
  Synthetic oligonucleotide
ccatctcaaaacatgctgtc

SEQ ID NO: 1866 - DNA, 20 bp, Artificial sequence
  Synthetic oligonucleotide
atgtactttttcccccttgg

SEQ ID NO: 1867 - DNA, 20 bp, Artificial sequence
  Synthetic oligonucleotide
tgggagattcttctttaatc

SEQ ID NO: 1868 - DNA, 20 bp, Artificial sequence
  Synthetic oligonucleotide
tggagattttacttaatttt

SEQ ID NO: 1869 - DNA, 20 bp, Artificial sequence
  Synthetic oligonucleotide
gataatatacacaaacaaca

SEQ ID NO: 1870 - DNA, 20 bp, Artificial sequence
  Synthetic oligonucleotide
tagactcattaagaaatgtc

SEQ ID NO: 1871 - DNA, 20 bp, Artificial sequence
  Synthetic oligonucleotide
agactctctaccagagttgc

SEQ ID NO: 1872 - DNA, 20 bp, Artificial sequence
  Synthetic oligonucleotide
tgtgtgacactatttggttt

SEQ ID NO: 1873 - DNA, 20 bp, Artificial sequence
  Synthetic oligonucleotide
ctgggctatttttataatgt

SEQ ID NO: 1874 - DNA, 20 bp, Artificial sequence
  Synthetic oligonucleotide
agacatgttcagacaaacag

SEQ ID NO: 1875 - DNA, 20 bp, Artificial sequence
  Synthetic oligonucleotide
acacataatttgaatcctag

SEQ ID NO: 1876 - DNA, 20 bp, Artificial sequence
  Synthetic oligonucleotide
actagcaaaatatcagatct

SEQ ID NO: 1877 - DNA, 20 bp, Artificial sequence
  Synthetic oligonucleotide
actttttttcttatagtact

SEQ ID NO: 1878 - DNA, 20 bp, Artificial sequence
  Synthetic oligonucleotide
tctgttagaaccagtcaatc

SEQ ID NO: 1879 - DNA, 20 bp, Artificial sequence
  Synthetic oligonucleotide
tcagactgcccatgttggcc

SEQ ID NO: 1880 - DNA, 20 bp, Artificial sequence
  Synthetic oligonucleotide
gagccgttcttcaggttctt

SEQ ID NO: 1881 - DNA, 20 bp, Artificial sequence
  Synthetic oligonucleotide
gcctggagccctgaccgctc

SEQ ID NO: 1882 - DNA, 20 bp, Artificial sequence
  Synthetic oligonucleotide
atgcaataacctgattggtt

SEQ ID NO: 1883 - DNA, 20 bp, Artificial sequence
  Synthetic oligonucleotide
attcatccctttaaaccaca

SEQ ID NO: 1884 - DNA, 20 bp, Artificial sequence
  Synthetic oligonucleotide
tcagtcccccaaacctttcc

SEQ ID NO: 1885 - DNA, 20 bp, Artificial sequence
  Synthetic oligonucleotide
gatgcattcaaaacccacaa

SEQ ID NO: 1886 - DNA, 20 bp, Artificial sequence
  Synthetic oligonucleotide
tgactgcaagaatgagccca

SEQ ID NO: 1887 - DNA, 20 bp, Artificial sequence
  Synthetic oligonucleotide
caattattttataattccta

SEQ ID NO: 1888 - DNA, 20 bp, Artificial sequence
  Synthetic oligonucleotide
gtggacatagtacagaggca

SEQ ID NO: 1889 - DNA, 20 bp, Artificial sequence
  Synthetic oligonucleotide
aggctcacaattccaagtta

SEQ ID NO: 1890 - DNA, 20 bp, Artificial sequence
  Synthetic oligonucleotide
tggagatttttctctctatg

SEQ ID NO: 1891 - DNA, 20 bp, Artificial sequence
  Synthetic oligonucleotide
ctgtatatttattacttgat

SEQ ID NO: 1892 - DNA, 20 bp, Artificial sequence
  Synthetic oligonucleotide
tcgacattcatttttctttt

SEQ ID NO: 1893 - DNA, 20 bp, Artificial sequence
  Synthetic oligonucleotide
atgtcaaacatcatctctga

SEQ ID NO: 1894 - DNA, 20 bp, Artificial sequence
  Synthetic oligonucleotide
gggtgcttaatatccccaca

SEQ ID NO: 1895 - DNA, 20 bp, Artificial sequence
  Synthetic oligonucleotide
gaaggccttcagattggcca

SEQ ID NO: 1896 - DNA, 20 bp, Artificial sequence
  Synthetic oligonucleotide
agtctggtagtgccctcaac

SEQ ID NO: 1897 - DNA, 20 bp, Artificial sequence
  Synthetic oligonucleotide
acaaatagacacaccacgat

SEQ ID NO: 1898 - DNA, 20 bp, Artificial sequence
  Synthetic oligonucleotide
gttgagttacaaatataaat

SEQ ID NO: 1899 - DNA, 20 bp, Artificial sequence
  Synthetic oligonucleotide
ccaggattttaaaaaaagca

SEQ ID NO: 1900 - DNA, 20 bp, Artificial sequence
  Synthetic oligonucleotide
gctaaatttccttaagcttt

SEQ ID NO: 1901 - DNA, 20 bp, Artificial sequence
  Synthetic oligonucleotide
catcagttccaaaacctgga

SEQ ID NO: 1902 - DNA, 20 bp, Artificial sequence
  Synthetic oligonucleotide
ccaatacacctttatttttc

SEQ ID NO: 1903 - DNA, 20 bp, Artificial sequence
  Synthetic oligonucleotide
cgattaatcccttatgtttt

SEQ ID NO: 1904 - DNA, 20 bp, Artificial sequence
  Synthetic oligonucleotide
ctcttcaaaaacatatccga

SEQ ID NO: 1905 - DNA, 20 bp, Artificial sequence
  Synthetic oligonucleotide
ttctaaatttaaaactccaa

SEQ ID NO: 1906 - DNA, 20 bp, Artificial sequence
  Synthetic oligonucleotide
acaggcaatatttactataa

SEQ ID NO: 1907 - DNA, 20 bp, Artificial sequence
  Synthetic oligonucleotide
gccttcttcctttatagcac

SEQ ID NO: 1908 - DNA, 20 bp, Artificial sequence
  Synthetic oligonucleotide
ttaggctattaaataataga

SEQ ID NO: 1909 - DNA, 20 bp, Artificial sequence
  Synthetic oligonucleotide
ctcagtatcttttaattgcc

SEQ ID NO: 1910 - DNA, 20 bp, Artificial sequence
  Synthetic oligonucleotide
tgggccaaaaacaccccttt

SEQ ID NO: 1911 - DNA, 20 bp, Artificial sequence
  Synthetic oligonucleotide
ctgtttaaaaatgtattgag

SEQ ID NO: 1912 - DNA, 20 bp, Artificial sequence
  Synthetic oligonucleotide
gtcccttatccttaacacac

SEQ ID NO: 1913 - DNA, 20 bp, Artificial sequence
  Synthetic oligonucleotide
ccctaaatttaaattctctg

SEQ ID NO: 1914 - DNA, 20 bp, Artificial sequence
  Synthetic oligonucleotide
acctttatttaaattttcca

SEQ ID NO: 1915 - DNA, 20 bp, Artificial sequence
  Synthetic oligonucleotide
gctcaatatatttatctatt

SEQ ID NO: 1916 - DNA, 20 bp, Artificial sequence
  Synthetic oligonucleotide
tctgtattttaaaaatctct

SEQ ID NO: 1917 - DNA, 20 bp, Artificial sequence
  Synthetic oligonucleotide
cgagaacccttaatcctgcc

SEQ ID NO: 1918 - DNA, 20 bp, Artificial sequence
  Synthetic oligonucleotide
cgaaggcatataccactgta

SEQ ID NO: 1919 - DNA, 20 bp, Artificial sequence
  Synthetic oligonucleotide
ccactctaaccaatcctaaa

SEQ ID NO: 1920 - DNA, 20 bp, Artificial sequence
  Synthetic oligonucleotide
ttttattttctgatgctttg

SEQ ID NO: 1921 - DNA, 20 bp, Artificial sequence
  Synthetic oligonucleotide
catgactattttcaactcaa

SEQ ID NO: 1922 - DNA, 20 bp, Artificial sequence
  Synthetic oligonucleotide
gctgtattattatgccattt

SEQ ID NO: 1923 - DNA, 20 bp, Artificial sequence
  Synthetic oligonucleotide
gtcgcatttctaaacaaaac

SEQ ID NO: 1924 - DNA, 20 bp, Artificial sequence
  Synthetic oligonucleotide
agtgacaaatcattggttgc

SEQ ID NO: 1925 - DNA, 20 bp, Artificial sequence
  Synthetic oligonucleotide
agtcacaatgccatctgttt

SEQ ID NO: 1926 - DNA, 20 bp, Artificial sequence
  Synthetic oligonucleotide
gctaataaatttttacaagg

SEQ ID NO: 1927 - DNA, 20 bp, Artificial sequence
  Synthetic oligonucleotide
tgctatcaccctccactgaa

SEQ ID NO: 1928 - DNA, 20 bp, Artificial sequence
  Synthetic oligonucleotide
cttccataaactctttttag

SEQ ID NO: 1929 - DNA, 20 bp, Artificial sequence
  Synthetic oligonucleotide
cagatggaagccaaaggctc

SEQ ID NO: 1930 - DNA, 20 bp, Artificial sequence
  Synthetic oligonucleotide
cagctaatccattcaatgca

SEQ ID NO: 1931 - DNA, 20 bp, Artificial sequence
  Synthetic oligonucleotide
gctataaacaacaacagtct

SEQ ID NO: 1932 - DNA, 20 bp, Artificial sequence
  Synthetic oligonucleotide
cacggaagcccttaggcaca

SEQ ID NO: 1933 - DNA, 20 bp, Artificial sequence
  Synthetic oligonucleotide
gagagacccatttactgcaa

SEQ ID NO: 1934 - DNA, 20 bp, Artificial sequence
  Synthetic oligonucleotide
gttttacaaaacattttttc

SEQ ID NO: 1935 - DNA, 20 bp, Artificial sequence
  Synthetic oligonucleotide
aattcctttcaccacttagt

SEQ ID NO: 1936 - DNA, 20 bp, Artificial sequence
  Synthetic oligonucleotide
ctctgtctttcatctctgga

SEQ ID NO: 1937 - DNA, 20 bp, Artificial sequence
  Synthetic oligonucleotide
cccaatgaaaataaactcat

SEQ ID NO: 1938 - DNA, 20 bp, Artificial sequence
  Synthetic oligonucleotide
ctctttccccaaactcagtg

SEQ ID NO: 1939 - DNA, 20 bp, Artificial sequence
  Synthetic oligonucleotide
gttctatttaaaataacaac

SEQ ID NO: 1940 - DNA, 20 bp, Artificial sequence
  Synthetic oligonucleotide
tataagcaaactgtatgggt

SEQ ID NO: 1941 - DNA, 20 bp, Artificial sequence
  Synthetic oligonucleotide
tcaggctttccagttttaat

SEQ ID NO: 1942 - DNA, 20 bp, Artificial sequence
  Synthetic oligonucleotide
ctccatctcaaaacatgctg

SEQ ID NO: 1943 - DNA, 20 bp, Artificial sequence
  Synthetic oligonucleotide
caatgtactttttccccctt

SEQ ID NO: 1944 - DNA, 20 bp, Artificial sequence
  Synthetic oligonucleotide
aatgaaatttatgttaacct

SEQ ID NO: 1945 - DNA, 20 bp, Artificial sequence
  Synthetic oligonucleotide
ttggagattttacttaattt

SEQ ID NO: 1946 - DNA, 20 bp, Artificial sequence
  Synthetic oligonucleotide
accgagataatatacacaaa

SEQ ID NO: 1947 - DNA, 20 bp, Artificial sequence
  Synthetic oligonucleotide
taggtaaacttatctgagga

SEQ ID NO: 1948 - DNA, 20 bp, Artificial sequence
  Synthetic oligonucleotide
tcaggtgttaacatctgtct

SEQ ID NO: 1949 - DNA, 20 bp, Artificial sequence
  Synthetic oligonucleotide
ctcatacaattctagttacc

SEQ ID NO: 1950 - DNA, 20 bp, Artificial sequence
  Synthetic oligonucleotide
gggaaagtttcattgttctg

SEQ ID NO: 1951 - DNA, 20 bp, Artificial sequence
  Synthetic oligonucleotide
gcaaaaagatccttccagaa

SEQ ID NO: 1952 - DNA, 20 bp, Artificial sequence
  Synthetic oligonucleotide
gctaacagacacataatttg

SEQ ID NO: 1953 - DNA, 20 bp, Artificial sequence
  Synthetic oligonucleotide
cactagcaaaatatcagatc

SEQ ID NO: 1954 - DNA, 20 bp, Artificial sequence
  Synthetic oligonucleotide
aactttttttcttatagtac

SEQ ID NO: 1955 - DNA, 20 bp, Artificial sequence
  Synthetic oligonucleotide
ttcaaaatattccatcaagt

SEQ ID NO: 1956 - DNA, 20 bp, Artificial sequence
  Synthetic oligonucleotide
tcaccgttcaggacctcctt

SEQ ID NO: 1957 - DNA, 20 bp, Artificial sequence
  Synthetic oligonucleotide
gccctttttaacagagccgt

SEQ ID NO: 1958 - DNA, 20 bp, Artificial sequence
  Synthetic oligonucleotide
gccccgttcctttcttcccc

SEQ ID NO: 1959 - DNA, 20 bp, Artificial sequence
  Synthetic oligonucleotide
gggagtgaagtcaatgcaat

SEQ ID NO: 1960 - DNA, 20 bp, Artificial sequence
  Synthetic oligonucleotide
cattcatccctttaaaccac

SEQ ID NO: 1961 - DNA, 20 bp, Artificial sequence
  Synthetic oligonucleotide
gttcagtcccccaaaccttt

SEQ ID NO: 1962 - DNA, 20 bp, Artificial sequence
  Synthetic oligonucleotide
agatgcattcaaaacccaca

SEQ ID NO: 1963 - DNA, 20 bp, Artificial sequence
  Synthetic oligonucleotide
cagcactaaataagcagtat

SEQ ID NO: 1964 - DNA, 20 bp, Artificial sequence
  Synthetic oligonucleotide
accaattattttataattcc

SEQ ID NO: 1965 - DNA, 20 bp, Artificial sequence
  Synthetic oligonucleotide
ctgtcggtaaatattgcaaa

SEQ ID NO: 1966 - DNA, 20 bp, Artificial sequence
  Synthetic oligonucleotide
ctaacagaaaacatagaggc

SEQ ID NO: 1967 - DNA, 20 bp, Artificial sequence
  Synthetic oligonucleotide
ttggagatttttctctctat

SEQ ID NO: 1968 - DNA, 20 bp, Artificial sequence
  Synthetic oligonucleotide
tctgtatatttattacttga

SEQ ID NO: 1969 - DNA, 20 bp, Artificial sequence
  Synthetic oligonucleotide
gccatatctttcaaacactg

SEQ ID NO: 1970 - DNA, 20 bp, Artificial sequence
  Synthetic oligonucleotide
aatgtcaaacatcatctctg

SEQ ID NO: 1971 - DNA, 20 bp, Artificial sequence
  Synthetic oligonucleotide
aatttaagaattgtaagtgg

SEQ ID NO: 1972 - DNA, 20 bp, Artificial sequence
  Synthetic oligonucleotide
aacgaaggccttcagattgg

SEQ ID NO: 1973 - DNA, 20 bp, Artificial sequence
  Synthetic oligonucleotide
tagttctcctctgtactggc

SEQ ID NO: 1974 - DNA, 20 bp, Artificial sequence
  Synthetic oligonucleotide
ctacaaatagacacaccacg

SEQ ID NO: 1975 - DNA, 20 bp, Artificial sequence
  Synthetic oligonucleotide
aacagtagccaaaatgttct

SEQ ID NO: 1976 - DNA, 20 bp, Artificial sequence
  Synthetic oligonucleotide
ctagaattttaaaaaaccag

SEQ ID NO: 1977 - DNA, 20 bp, Artificial sequence
  Synthetic oligonucleotide
agtacaatcttttatagata

SEQ ID NO: 1978 - DNA, 20 bp, Artificial sequence
  Synthetic oligonucleotide
tgcctgagaatttaatacta

SEQ ID NO: 1979 - DNA, 20 bp, Artificial sequence
  Synthetic oligonucleotide
agtaagcttctttaacttta

SEQ ID NO: 1980 - DNA, 20 bp, Artificial sequence
  Synthetic oligonucleotide
tggataattatttaattcat

SEQ ID NO: 1981 - DNA, 20 bp, Artificial sequence
  Synthetic oligonucleotide
ccaaactaagaataatctag

SEQ ID NO: 1982 - DNA, 20 bp, Artificial sequence
  Synthetic oligonucleotide
gaggaaattatttactggct

SEQ ID NO: 1983 - DNA, 20 bp, Artificial sequence
  Synthetic oligonucleotide
atgcacatacaaataagctc

SEQ ID NO: 1984 - DNA, 20 bp, Artificial sequence
  Synthetic oligonucleotide
gagattaaaatacaattgct

SEQ ID NO: 1985 - DNA, 20 bp, Artificial sequence
  Synthetic oligonucleotide
gatttctccttttaacctct

SEQ ID NO: 1986 - DNA, 20 bp, Artificial sequence
  Synthetic oligonucleotide
ttctcaaaaccttatctcct

SEQ ID NO: 1987 - DNA, 20 bp, Artificial sequence
  Synthetic oligonucleotide
cattttattccttatcctac

SEQ ID NO: 1988 - DNA, 20 bp, Artificial sequence
  Synthetic oligonucleotide
catttgcacctttaatttgt

SEQ ID NO: 1989 - DNA, 20 bp, Artificial sequence
  Synthetic oligonucleotide
ttccaaaaagaatgtgtccc

SEQ ID NO: 1990 - DNA, 20 bp, Artificial sequence
  Synthetic oligonucleotide
ggtagctatcattattaagc

SEQ ID NO: 1991 - DNA, 20 bp, Artificial sequence
  Synthetic oligonucleotide
cgacagaaaatatatctgct

SEQ ID NO: 1992 - DNA, 20 bp, Artificial sequence
  Synthetic oligonucleotide
gactgcaaaattcccattgc

SEQ ID NO: 1993 - DNA, 20 bp, Artificial sequence
  Synthetic oligonucleotide
ctgtaaaaatacacatcctc

SEQ ID NO: 1994 - DNA, 20 bp, Artificial sequence
  Synthetic oligonucleotide
cccgagaacccttaatcctg

SEQ ID NO: 1995 - DNA, 20 bp, Artificial sequence
  Synthetic oligonucleotide
cacaggttcagccatagctc

SEQ ID NO: 1996 - DNA, 20 bp, Artificial sequence
  Synthetic oligonucleotide
tccactctaaccaatcctaa

SEQ ID NO: 1997 - DNA, 20 bp, Artificial sequence
  Synthetic oligonucleotide
cgcttttattttctgatgct

SEQ ID NO: 1998 - DNA, 20 bp, Artificial sequence
  Synthetic oligonucleotide
tcatgactattttcaactca

SEQ ID NO: 1999 - DNA, 20 bp, Artificial sequence
  Synthetic oligonucleotide
agctgtattattatgccatt

SEQ ID NO: 2000 - DNA, 20 bp, Artificial sequence
  Synthetic oligonucleotide
agtcgcatttctaaacaaaa

SEQ ID NO: 2001 - DNA, 20 bp, Artificial sequence
  Synthetic oligonucleotide
aagtgacaaatcattggttg

SEQ ID NO: 2002 - DNA, 20 bp, Artificial sequence
  Synthetic oligonucleotide
gcctagagtcacaatgccat

SEQ ID NO: 2003 - DNA, 20 bp, Artificial sequence
  Synthetic oligonucleotide
cgctaataaatttttacaag

SEQ ID NO: 2004 - DNA, 20 bp, Artificial sequence
  Synthetic oligonucleotide
tcaaccagaatcaaggcatg

SEQ ID NO: 2005 - DNA, 20 bp, Artificial sequence
  Synthetic oligonucleotide
ctctccttccataaactctt

SEQ ID NO: 2006 - DNA, 20 bp, Artificial sequence
  Synthetic oligonucleotide
gatgggataatatagaacgc

SEQ ID NO: 2007 - DNA, 20 bp, Artificial sequence
  Synthetic oligonucleotide
ccagctaatccattcaatgc

SEQ ID NO: 2008 - DNA, 20 bp, Artificial sequence
  Synthetic oligonucleotide
atgctataaacaacaacagt

SEQ ID NO: 2009 - DNA, 20 bp, Artificial sequence
  Synthetic oligonucleotide
gacacggaagcccttaggca

SEQ ID NO: 2010 - DNA, 20 bp, Artificial sequence
  Synthetic oligonucleotide
gcgagagacccatttactgc

SEQ ID NO: 2011 - DNA, 20 bp, Artificial sequence
  Synthetic oligonucleotide
ggcatctgttttacaaaaca

SEQ ID NO: 2012 - DNA, 20 bp, Artificial sequence
  Synthetic oligonucleotide
aataaaattcctttcaccac

SEQ ID NO: 2013 - DNA, 20 bp, Artificial sequence
  Synthetic oligonucleotide
ctttatacttttgtaagctt

SEQ ID NO: 2014 - DNA, 20 bp, Artificial sequence
  Synthetic oligonucleotide
tcccaatgaaaataaactca

SEQ ID NO: 2015 - DNA, 20 bp, Artificial sequence
  Synthetic oligonucleotide
gcctctttccccaaactcag

SEQ ID NO: 2016 - DNA, 20 bp, Artificial sequence
  Synthetic oligonucleotide
cagttctatttaaaataaca

SEQ ID NO: 2017 - DNA, 20 bp, Artificial sequence
  Synthetic oligonucleotide
atcccaattataagcaaact

SEQ ID NO: 2018 - DNA, 20 bp, Artificial sequence
  Synthetic oligonucleotide
tttcaggctttccagtttta

SEQ ID NO: 2019 - DNA, 20 bp, Artificial sequence
  Synthetic oligonucleotide
tctccatctcaaaacatgct

SEQ ID NO: 2020 - DNA, 20 bp, Artificial sequence
  Synthetic oligonucleotide
ctacctagacaatgtacttt

SEQ ID NO: 2021 - DNA, 20 bp, Artificial sequence
  Synthetic oligonucleotide
cccacctggcctgttaatga

SEQ ID NO: 2022 - DNA, 20 bp, Artificial sequence
  Synthetic oligonucleotide
ccagcctaaaaaattggaga

SEQ ID NO: 2023 - DNA, 20 bp, Artificial sequence
  Synthetic oligonucleotide
caccgagataatatacacaa

SEQ ID NO: 2024 - DNA, 20 bp, Artificial sequence
  Synthetic oligonucleotide
actgtgttctcataggtaaa

SEQ ID NO: 2025 - DNA, 20 bp, Artificial sequence
  Synthetic oligonucleotide
aagtcataaaaataaaactc

SEQ ID NO: 2026 - DNA, 20 bp, Artificial sequence
  Synthetic oligonucleotide
actcatacaattctagttac

SEQ ID NO: 2027 - DNA, 20 bp, Artificial sequence
  Synthetic oligonucleotide
agcatgaaccccttctcctg

SEQ ID NO: 2028 - DNA, 20 bp, Artificial sequence
  Synthetic oligonucleotide
agcaaaaagatccttccaga

SEQ ID NO: 2029 - DNA, 20 bp, Artificial sequence
  Synthetic oligonucleotide
atagagacaaaaagatggtc

SEQ ID NO: 2030 - DNA, 20 bp, Artificial sequence
  Synthetic oligonucleotide
gcactagcaaaatatcagat

SEQ ID NO: 2031 - DNA, 20 bp, Artificial sequence
  Synthetic oligonucleotide
tctggacaaaatgtttaaac

SEQ ID NO: 2032 - DNA, 20 bp, Artificial sequence
  Synthetic oligonucleotide
aatattcaaaatattccatc

SEQ ID NO: 2033 - DNA, 20 bp, Artificial sequence
  Synthetic oligonucleotide
ctcaccgttcaggacctcct

SEQ ID NO: 2034 - DNA, 20 bp, Artificial sequence
  Synthetic oligonucleotide
tggccctttttaacagagcc

SEQ ID NO: 2035 - DNA, 20 bp, Artificial sequence
  Synthetic oligonucleotide
agccccgttcctttcttccc

SEQ ID NO: 2036 - DNA, 20 bp, Artificial sequence
  Synthetic oligonucleotide
ttgcatctacctcttgggag

SEQ ID NO: 2037 - DNA, 20 bp, Artificial sequence
  Synthetic oligonucleotide
acattcatccctttaaacca

SEQ ID NO: 2038 - DNA, 20 bp, Artificial sequence
  Synthetic oligonucleotide
gctacatttatttatgctcg

SEQ ID NO: 2039 - DNA, 20 bp, Artificial sequence
  Synthetic oligonucleotide
gcactttaaagatgcattca

SEQ ID NO: 2040 - DNA, 20 bp, Artificial sequence
  Synthetic oligonucleotide
acagcactaaataagcagta

SEQ ID NO: 2041 - DNA, 20 bp, Artificial sequence
  Synthetic oligonucleotide
aaccaattattttataattc

SEQ ID NO: 2042 - DNA, 20 bp, Artificial sequence
  Synthetic oligonucleotide
gctgtcggtaaatattgcaa

SEQ ID NO: 2043 - DNA, 20 bp, Artificial sequence
  Synthetic oligonucleotide
acctaacagaaaacatagag

SEQ ID NO: 2044 - DNA, 20 bp, Artificial sequence
  Synthetic oligonucleotide
agtgtcttcaaaagcattgg

SEQ ID NO: 2045 - DNA, 20 bp, Artificial sequence
  Synthetic oligonucleotide
tctctgtatatttattactt

SEQ ID NO: 2046 - DNA, 20 bp, Artificial sequence
  Synthetic oligonucleotide
agccatatctttcaaacact

SEQ ID NO: 2047 - DNA, 20 bp, Artificial sequence
  Synthetic oligonucleotide
tctttgggtttataggaaca

SEQ ID NO: 2048 - DNA, 20 bp, Artificial sequence
  Synthetic oligonucleotide
ttctgaatttaagaattgta

SEQ ID NO: 2049 - DNA, 20 bp, Artificial sequence
  Synthetic oligonucleotide
cacttccaacgaaggccttc

SEQ ID NO: 2050 - DNA, 20 bp, Artificial sequence
  Synthetic oligonucleotide
ccctagttctcctctgtact

SEQ ID NO: 2051 - DNA, 20 bp, Artificial sequence
  Synthetic oligonucleotide
gtatcctacaaatagacaca

SEQ ID NO: 2052 - DNA, 20 bp, Artificial sequence
  Synthetic oligonucleotide
actcactatttttaagagca

SEQ ID NO: 2053 - DNA, 20 bp, Artificial sequence
  Synthetic oligonucleotide
ctgggaatttaaaaaacaaa

SEQ ID NO: 2054 - DNA, 20 bp, Artificial sequence
  Synthetic oligonucleotide
tccataaacatttatacaga

SEQ ID NO: 2055 - DNA, 20 bp, Artificial sequence
  Synthetic oligonucleotide
ggttcaaaaccttagtcaga

SEQ ID NO: 2056 - DNA, 20 bp, Artificial sequence
  Synthetic oligonucleotide
atagaatatttttatcattc

SEQ ID NO: 2057 - DNA, 20 bp, Artificial sequence
  Synthetic oligonucleotide
gaataaattatttactgcgg

SEQ ID NO: 2058 - DNA, 20 bp, Artificial sequence
  Synthetic oligonucleotide
ggtcaatttcaaactgttct

SEQ ID NO: 2059 - DNA, 20 bp, Artificial sequence
  Synthetic oligonucleotide
ggcctaaaactattcttgat

SEQ ID NO: 2060 - DNA, 20 bp, Artificial sequence
  Synthetic oligonucleotide
acacttaaacctgttaatat

SEQ ID NO: 2061 - DNA, 20 bp, Artificial sequence
  Synthetic oligonucleotide
gctcataaaatacctctcta

SEQ ID NO: 2062 - DNA, 20 bp, Artificial sequence
  Synthetic oligonucleotide
ccaggaaagatttatttagc

SEQ ID NO: 2063 - DNA, 20 bp, Artificial sequence
  Synthetic oligonucleotide
agcacatttcaaaagttcag

SEQ ID NO: 2064 - DNA, 20 bp, Artificial sequence
  Synthetic oligonucleotide
attcattttccttatgttac

SEQ ID NO: 2065 - DNA, 20 bp, Artificial sequence
  Synthetic oligonucleotide
tcacccaaacccattgccta

SEQ ID NO: 2066 - DNA, 20 bp, Artificial sequence
  Synthetic oligonucleotide
ttctgtaaaatatatcctgt

SEQ ID NO: 2067 - DNA, 20 bp, Artificial sequence
  Synthetic oligonucleotide
atctgtaaaatatggttgca

SEQ ID NO: 2068 - DNA, 20 bp, Artificial sequence
  Synthetic oligonucleotide
aacttattttaaagtgtcca

SEQ ID NO: 2069 - DNA, 20 bp, Artificial sequence
  Synthetic oligonucleotide
acattatacccttaatatcc

SEQ ID NO: 2070 - DNA, 20 bp, Artificial sequence
  Synthetic oligonucleotide
gctgtaaaaatacacatcct

SEQ ID NO: 2071 - DNA, 20 bp, Artificial sequence
  Synthetic oligonucleotide
gcttattttttctagagaac

SEQ ID NO: 2072 - DNA, 20 bp, Artificial sequence
  Synthetic oligonucleotide
agtgatagtcacaggttcag

SEQ ID NO: 2073 - DNA, 20 bp, Artificial sequence
  Synthetic oligonucleotide
ttatccactctaaccaatcc

SEQ ID NO: 2074 - DNA, 20 bp, Artificial sequence
  Synthetic oligonucleotide
ccacgcttttattttctgat

SEQ ID NO: 2075 - DNA, 20 bp, Artificial sequence
  Synthetic oligonucleotide
cagctatttcatgactattt

SEQ ID NO: 2076 - DNA, 20 bp, Artificial sequence
  Synthetic oligonucleotide
gagctgtattattatgccat

SEQ ID NO: 2077 - DNA, 20 bp, Artificial sequence
  Synthetic oligonucleotide
cagtcgcatttctaaacaaa

SEQ ID NO: 2078 - DNA, 20 bp, Artificial sequence
  Synthetic oligonucleotide
cggtaaagtgacaaatcatt

SEQ ID NO: 2079 - DNA, 20 bp, Artificial sequence
  Synthetic oligonucleotide
ctgcctagagtcacaatgcc

SEQ ID NO: 2080 - DNA, 20 bp, Artificial sequence
  Synthetic oligonucleotide
acgctaataaatttttacaa

SEQ ID NO: 2081 - DNA, 20 bp, Artificial sequence
  Synthetic oligonucleotide
actctcaaccagaatcaagg

SEQ ID NO: 2082 - DNA, 20 bp, Artificial sequence
  Synthetic oligonucleotide
cctctccttccataaactct

SEQ ID NO: 2083 - DNA, 20 bp, Artificial sequence
  Synthetic oligonucleotide
ctgtgtactcttcagagaag

SEQ ID NO: 2084 - DNA, 20 bp, Artificial sequence
  Synthetic oligonucleotide
accagctaatccattcaatg

SEQ ID NO: 2085 - DNA, 20 bp, Artificial sequence
  Synthetic oligonucleotide
aacaatagtctttaattttt

SEQ ID NO: 2086 - DNA, 20 bp, Artificial sequence
  Synthetic oligonucleotide
gtgagtgaccacagcagctg

SEQ ID NO: 2087 - DNA, 20 bp, Artificial sequence
  Synthetic oligonucleotide
agcgagagacccatttactg

SEQ ID NO: 2088 - DNA, 20 bp, Artificial sequence
  Synthetic oligonucleotide
ctgttttcacaaattgcgaa

SEQ ID NO: 2089 - DNA, 20 bp, Artificial sequence
  Synthetic oligonucleotide
caataaaattcctttcacca

SEQ ID NO: 2090 - DNA, 20 bp, Artificial sequence
  Synthetic oligonucleotide
gcctttatacttttgtaagc

SEQ ID NO: 2091 - DNA, 20 bp, Artificial sequence
  Synthetic oligonucleotide
gtttctgattaaatcccaat

SEQ ID NO: 2092 - DNA, 20 bp, Artificial sequence
  Synthetic oligonucleotide
tgcctctttccccaaactca

SEQ ID NO: 2093 - DNA, 20 bp, Artificial sequence
  Synthetic oligonucleotide
gagaactcccctgacagttc

SEQ ID NO: 2094 - DNA, 20 bp, Artificial sequence
  Synthetic oligonucleotide
acatcacaaacatcccaatt

SEQ ID NO: 2095 - DNA, 20 bp, Artificial sequence
  Synthetic oligonucleotide
gatacatttcaggctttcca

SEQ ID NO: 2096 - DNA, 20 bp, Artificial sequence
  Synthetic oligonucleotide
cttgaaattcccttggagag

SEQ ID NO: 2097 - DNA, 20 bp, Artificial sequence
  Synthetic oligonucleotide
aactacctagacaatgtact

SEQ ID NO: 2098 - DNA, 20 bp, Artificial sequence
  Synthetic oligonucleotide
cgtactaaaacaagatgacg

SEQ ID NO: 2099 - DNA, 20 bp, Artificial sequence
  Synthetic oligonucleotide
accagcctaaaaaattggag

SEQ ID NO: 2100 - DNA, 20 bp, Artificial sequence
  Synthetic oligonucleotide
gcaccgagataatatacaca

SEQ ID NO: 2101 - DNA, 20 bp, Artificial sequence
  Synthetic oligonucleotide
tctgaaaataacatctactg

SEQ ID NO: 2102 - DNA, 20 bp, Artificial sequence
  Synthetic oligonucleotide
ccaagtcataaaaataaaac

SEQ ID NO: 2103 - DNA, 20 bp, Artificial sequence
  Synthetic oligonucleotide
atagccactcatacaattct

SEQ ID NO: 2104 - DNA, 20 bp, Artificial sequence
  Synthetic oligonucleotide
aagcatgaaccccttctcct

SEQ ID NO: 2105 - DNA, 20 bp, Artificial sequence
  Synthetic oligonucleotide
ggagcaaaaagatccttcca

SEQ ID NO: 2106 - DNA, 20 bp, Artificial sequence
  Synthetic oligonucleotide
ggattctctaattagagctt

SEQ ID NO: 2107 - DNA, 20 bp, Artificial sequence
  Synthetic oligonucleotide
gaggagaccagatagcttgt

SEQ ID NO: 2108 - DNA, 20 bp, Artificial sequence
  Synthetic oligonucleotide
ctctggacaaaatgtttaaa

SEQ ID NO: 2109 - DNA, 20 bp, Artificial sequence
  Synthetic oligonucleotide
tcaatattcaaaatattcca

SEQ ID NO: 2110 - DNA, 20 bp, Artificial sequence
  Synthetic oligonucleotide
gggcaggaccatcacagagg

SEQ ID NO: 2111 - DNA, 20 bp, Artificial sequence
  Synthetic oligonucleotide
ctggccctttttaacagagc

SEQ ID NO: 2112 - DNA, 20 bp, Artificial sequence
  Synthetic oligonucleotide
ctgcaggacccttcccacgg

SEQ ID NO: 2113 - DNA, 20 bp, Artificial sequence
  Synthetic oligonucleotide
tcaaagacaaaaagatttcg

SEQ ID NO: 2114 - DNA, 20 bp, Artificial sequence
  Synthetic oligonucleotide
attcacattcatccctttaa

SEQ ID NO: 2115 - DNA, 20 bp, Artificial sequence
  Synthetic oligonucleotide
gttagaaagaaattttgcta

SEQ ID NO: 2116 - DNA, 20 bp, Artificial sequence
  Synthetic oligonucleotide
cctacttataaaactttttt

SEQ ID NO: 2117 - DNA, 20 bp, Artificial sequence
  Synthetic oligonucleotide
tacagcactaaataagcagt

SEQ ID NO: 2118 - DNA, 20 bp, Artificial sequence
  Synthetic oligonucleotide
cacatgctaaaaaagcaaga

SEQ ID NO: 2119 - DNA, 20 bp, Artificial sequence
  Synthetic oligonucleotide
aagaaagaacaaaagacggc

SEQ ID NO: 2120 - DNA, 20 bp, Artificial sequence
  Synthetic oligonucleotide
cacctaacagaaaacataga

SEQ ID NO: 2121 - DNA, 20 bp, Artificial sequence
  Synthetic oligonucleotide
tagtgtcttcaaaagcattg

SEQ ID NO: 2122 - DNA, 20 bp, Artificial sequence
  Synthetic oligonucleotide
agtatattctctgtatattt

SEQ ID NO: 2123 - DNA, 20 bp, Artificial sequence
  Synthetic oligonucleotide
gagccatatctttcaaacac

SEQ ID NO: 2124 - DNA, 20 bp, Artificial sequence
  Synthetic oligonucleotide
ttcaagattatattctttgg

SEQ ID NO: 2125 - DNA, 20 bp, Artificial sequence
  Synthetic oligonucleotide
gttgccttcaacgagaaggg

SEQ ID NO: 2126 - DNA, 20 bp, Artificial sequence
  Synthetic oligonucleotide
actgtaaacaacacttccaa

SEQ ID NO: 2127 - DNA, 20 bp, Artificial sequence
  Synthetic oligonucleotide
acatcattccttccctagtt

SEQ ID NO: 2128 - DNA, 20 bp, Artificial sequence
  Synthetic oligonucleotide
tgtatcctacaaatagacac

SEQ ID NO: 2129 - DNA, 20 bp, Artificial sequence
  Synthetic oligonucleotide
ggctgattttaaacttagtt

SEQ ID NO: 2130 - DNA, 20 bp, Artificial sequence
  Synthetic oligonucleotide
gttttatatttttaagtgct

SEQ ID NO: 2131 - DNA, 20 bp, Artificial sequence
  Synthetic oligonucleotide
acatttaaaatatttcagac

SEQ ID NO: 2132 - DNA, 20 bp, Artificial sequence
  Synthetic oligonucleotide
tgtctattttaaagactcaa

SEQ ID NO: 2133 - DNA, 20 bp, Artificial sequence
  Synthetic oligonucleotide
ggatatctattttaattctt

SEQ ID NO: 2134 - DNA, 20 bp, Artificial sequence
  Synthetic oligonucleotide
acagtatttcaaaagaagcc

SEQ ID NO: 2135 - DNA, 20 bp, Artificial sequence
  Synthetic oligonucleotide
ctggataatacctaactgtc

SEQ ID NO: 2136 - DNA, 20 bp, Artificial sequence
  Synthetic oligonucleotide
agtgacttagattatccttt

SEQ ID NO: 2137 - DNA, 20 bp, Artificial sequence
  Synthetic oligonucleotide
cacatcaaacctcaagggca

SEQ ID NO: 2138 - DNA, 20 bp, Artificial sequence
  Synthetic oligonucleotide
gtttccctaatttatggagt

SEQ ID NO: 2139 - DNA, 20 bp, Artificial sequence
  Synthetic oligonucleotide
attcttacaatttacttgta

SEQ ID NO: 2140 - DNA, 20 bp, Artificial sequence
  Synthetic oligonucleotide
attctcttttaaagataaag

SEQ ID NO: 2141 - DNA, 20 bp, Artificial sequence
  Synthetic oligonucleotide
ctatggttttaaaattcatt

SEQ ID NO: 2142 - DNA, 20 bp, Artificial sequence
  Synthetic oligonucleotide
actaccagcccttatttcag

SEQ ID NO: 2143 - DNA, 20 bp, Artificial sequence
  Synthetic oligonucleotide
ctctgctttcaaatgtgttt

SEQ ID NO: 2144 - DNA, 20 bp, Artificial sequence
  Synthetic oligonucleotide
tctttcatattttaaagtgc

SEQ ID NO: 2145 - DNA, 20 bp, Artificial sequence
  Synthetic oligonucleotide
tccagtaaaaacacaacact

SEQ ID NO: 2146 - DNA, 20 bp, Artificial sequence
  Synthetic oligonucleotide
tataatatacattataccct

SEQ ID NO: 2147 - DNA, 20 bp, Artificial sequence
  Synthetic oligonucleotide
ccacaattacaaacacactt

SEQ ID NO: 2148 - DNA, 20 bp, Artificial sequence
  Synthetic oligonucleotide
ggcttattttttctagagaa

SEQ ID NO: 2149 - DNA, 20 bp, Artificial sequence
  Synthetic oligonucleotide
gcagtgatagtcacaggttc

SEQ ID NO: 2150 - DNA, 20 bp, Artificial sequence
  Synthetic oligonucleotide
ggaattatccactctaacca

SEQ ID NO: 2151 - DNA, 20 bp, Artificial sequence
  Synthetic oligonucleotide
tgtattaaccacgcttttat

SEQ ID NO: 2152 - DNA, 20 bp, Artificial sequence
  Synthetic oligonucleotide
agcagctatttcatgactat

SEQ ID NO: 2153 - DNA, 20 bp, Artificial sequence
  Synthetic oligonucleotide
gtgagctgtattattatgcc

SEQ ID NO: 2154 - DNA, 20 bp, Artificial sequence
  Synthetic oligonucleotide
gcaaggaaccagtcgcattt

SEQ ID NO: 2155 - DNA, 20 bp, Artificial sequence
  Synthetic oligonucleotide
agccgatttctgataggctc

SEQ ID NO: 2156 - DNA, 20 bp, Artificial sequence
  Synthetic oligonucleotide
gcaggatttctgcctagagt

SEQ ID NO: 2157 - DNA, 20 bp, Artificial sequence
  Synthetic oligonucleotide
atgttcatcttaatgctctt

SEQ ID NO: 2158 - DNA, 20 bp, Artificial sequence
  Synthetic oligonucleotide
gactctcaaccagaatcaag

SEQ ID NO: 2159 - DNA, 20 bp, Artificial sequence
  Synthetic oligonucleotide
tgcctctccttccataaact

SEQ ID NO: 2160 - DNA, 20 bp, Artificial sequence
  Synthetic oligonucleotide
ttttacaactccactgagca

SEQ ID NO: 2161 - DNA, 20 bp, Artificial sequence
  Synthetic oligonucleotide
ctcggctatttttaggtacc

SEQ ID NO: 2162 - DNA, 20 bp, Artificial sequence
  Synthetic oligonucleotide
tgctttaaacaatagtcttt

SEQ ID NO: 2163 - DNA, 20 bp, Artificial sequence
  Synthetic oligonucleotide
ccagtgagtgaccacagcag

SEQ ID NO: 2164 - DNA, 20 bp, Artificial sequence
  Synthetic oligonucleotide
accccgtctcaaagatgaag

SEQ ID NO: 2165 - DNA, 20 bp, Artificial sequence
  Synthetic oligonucleotide
ccctgttttcacaaattgcg

SEQ ID NO: 2166 - DNA, 20 bp, Artificial sequence
  Synthetic oligonucleotide
tcaataaaattcctttcacc

SEQ ID NO: 2167 - DNA, 20 bp, Artificial sequence
  Synthetic oligonucleotide
ggcctttatacttttgtaag

SEQ ID NO: 2168 - DNA, 20 bp, Artificial sequence
  Synthetic oligonucleotide
tggtttctgattaaatccca

SEQ ID NO: 2169 - DNA, 20 bp, Artificial sequence
  Synthetic oligonucleotide
tttacttgtatatttgtctg

SEQ ID NO: 2170 - DNA, 20 bp, Artificial sequence
  Synthetic oligonucleotide
ctgtccttttcagagagaac

SEQ ID NO: 2171 - DNA, 20 bp, Artificial sequence
  Synthetic oligonucleotide
tacatcacaaacatcccaat

SEQ ID NO: 2172 - DNA, 20 bp, Artificial sequence
  Synthetic oligonucleotide
aatgatacatttcaggcttt

SEQ ID NO: 2173 - DNA, 20 bp, Artificial sequence
  Synthetic oligonucleotide
atatatcatcaaatctgttg

SEQ ID NO: 2174 - DNA, 20 bp, Artificial sequence
  Synthetic oligonucleotide
ttagtgtgaactacctagac

SEQ ID NO: 2175 - DNA, 20 bp, Artificial sequence
  Synthetic oligonucleotide
ctgccgaaaaattcacgaga

SEQ ID NO: 2176 - DNA, 20 bp, Artificial sequence
  Synthetic oligonucleotide
aaccagcctaaaaaattgga

SEQ ID NO: 2177 - DNA, 20 bp, Artificial sequence
  Synthetic oligonucleotide
aggataattttatggcaccg

SEQ ID NO: 2178 - DNA, 20 bp, Artificial sequence
  Synthetic oligonucleotide
gcaatatttaattttctgaa

SEQ ID NO: 2179 - DNA, 20 bp, Artificial sequence
  Synthetic oligonucleotide
tgctgcaaatccaagtcata

SEQ ID NO: 2180 - DNA, 20 bp, Artificial sequence
  Synthetic oligonucleotide
ccttatagccactcatacaa

SEQ ID NO: 2181 - DNA, 20 bp, Artificial sequence
  Synthetic oligonucleotide
agtacattcatatggcagct

SEQ ID NO: 2182 - DNA, 20 bp, Artificial sequence
  Synthetic oligonucleotide
ggcgaattctatatggagca

SEQ ID NO: 2183 - DNA, 20 bp, Artificial sequence
  Synthetic oligonucleotide
aactggattctctaattaga

SEQ ID NO: 2184 - DNA, 20 bp, Artificial sequence
  Synthetic oligonucleotide
gcattcaatttaaaaaaggg

SEQ ID NO: 2185 - DNA, 20 bp, Artificial sequence
  Synthetic oligonucleotide
aataaatttaaaaactctgg

SEQ ID NO: 2186 - DNA, 20 bp, Artificial sequence
  Synthetic oligonucleotide
atcaatattcaaaatattcc

SEQ ID NO: 2187 - DNA, 20 bp, Artificial sequence
  Synthetic oligonucleotide
ctgttgcacctccaggtcag

SEQ ID NO: 2188 - DNA, 20 bp, Artificial sequence
  Synthetic oligonucleotide
gctggccctttttaacagag

SEQ ID NO: 2189 - DNA, 20 bp, Artificial sequence
  Synthetic oligonucleotide
cctgtgcacccccacatgcg

SEQ ID NO: 2190 - DNA, 20 bp, Artificial sequence
  Synthetic oligonucleotide
tgaactataaacagtactag

SEQ ID NO: 2191 - DNA, 20 bp, Artificial sequence
  Synthetic oligonucleotide
aattcacattcatcccttta

SEQ ID NO: 2192 - DNA, 20 bp, Artificial sequence
  Synthetic oligonucleotide
aaccttataaaatggcctag

SEQ ID NO: 2193 - DNA, 20 bp, Artificial sequence
  Synthetic oligonucleotide
tctccctacttataaaactt

SEQ ID NO: 2194 - DNA, 20 bp, Artificial sequence
  Synthetic oligonucleotide
atacagcactaaataagcag

SEQ ID NO: 2195 - DNA, 20 bp, Artificial sequence
  Synthetic oligonucleotide
ggtcagactctattggcaca

SEQ ID NO: 2196 - DNA, 20 bp, Artificial sequence
  Synthetic oligonucleotide
ttactagtttaaaaatggaa

SEQ ID NO: 2197 - DNA, 20 bp, Artificial sequence
  Synthetic oligonucleotide
acacactcacctaacagaaa

SEQ ID NO: 2198 - DNA, 20 bp, Artificial sequence
  Synthetic oligonucleotide
cttcctcacccatatctgaa

SEQ ID NO: 2199 - DNA, 20 bp, Artificial sequence
  Synthetic oligonucleotide
gctttataaaaaagtatatt

SEQ ID NO: 2200 - DNA, 20 bp, Artificial sequence
  Synthetic oligonucleotide
agagccatatctttcaaaca

SEQ ID NO: 2201 - DNA, 20 bp, Artificial sequence
  Synthetic oligonucleotide
tgttcaagattatattcttt

SEQ ID NO: 2202 - DNA, 20 bp, Artificial sequence
  Synthetic oligonucleotide
aacagttgccttcaacgaga

SEQ ID NO: 2203 - DNA, 20 bp, Artificial sequence
  Synthetic oligonucleotide
attactgtaaacaacacttc

SEQ ID NO: 2204 - DNA, 20 bp, Artificial sequence
  Synthetic oligonucleotide
aacatcattccttccctagt

SEQ ID NO: 2205 - DNA, 20 bp, Artificial sequence
  Synthetic oligonucleotide
gagtgtatcctacaaataga

SEQ ID NO: 2206 - DNA, 20 bp, Artificial sequence
  Synthetic oligonucleotide
tctagcaaacctctttttcc

SEQ ID NO: 2207 - DNA, 20 bp, Artificial sequence
  Synthetic oligonucleotide
aggtataaatcccctttcca

SEQ ID NO: 2208 - DNA, 20 bp, Artificial sequence
  Synthetic oligonucleotide
gatagtaatcaaacctgagt

SEQ ID NO: 2209 - DNA, 20 bp, Artificial sequence
  Synthetic oligonucleotide
atttgtctattttaaagact

SEQ ID NO: 2210 - DNA, 20 bp, Artificial sequence
  Synthetic oligonucleotide
atgagtaaaatatggtcctt

SEQ ID NO: 2211 - DNA, 20 bp, Artificial sequence
  Synthetic oligonucleotide
cacttcataatttaatattt

SEQ ID NO: 2212 - DNA, 20 bp, Artificial sequence
  Synthetic oligonucleotide
gtgatattttaaagacttac

SEQ ID NO: 2213 - DNA, 20 bp, Artificial sequence
  Synthetic oligonucleotide
agggccttattttaatcaca

SEQ ID NO: 2214 - DNA, 20 bp, Artificial sequence
  Synthetic oligonucleotide
catttatttccttacccagt

SEQ ID NO: 2215 - DNA, 20 bp, Artificial sequence
  Synthetic oligonucleotide
gtgtctaaaaccaactgggt

SEQ ID NO: 2216 - DNA, 20 bp, Artificial sequence
  Synthetic oligonucleotide
aagccaatattttattttga

SEQ ID NO: 2217 - DNA, 20 bp, Artificial sequence
  Synthetic oligonucleotide
ggtgataaagatatcattac

SEQ ID NO: 2218 - DNA, 20 bp, Artificial sequence
  Synthetic oligonucleotide
ttcgaaattctttatttgat

SEQ ID NO: 2219 - DNA, 20 bp, Artificial sequence
  Synthetic oligonucleotide
cactataaagaatgatgagt

SEQ ID NO: 2220 - DNA, 20 bp, Artificial sequence
  Synthetic oligonucleotide
tagagaaaacgatgttggct

SEQ ID NO: 2221 - DNA, 20 bp, Artificial sequence
  Synthetic oligonucleotide
ccttcggctatttaataata

SEQ ID NO: 2222 - DNA, 20 bp, Artificial sequence
  Synthetic oligonucleotide
aggcatctaatttaaattca

SEQ ID NO: 2223 - DNA, 20 bp, Artificial sequence
  Synthetic oligonucleotide
gcttgtaaaactatggcggc

SEQ ID NO: 2224 - DNA, 20 bp, Artificial sequence
  Synthetic oligonucleotide
ggcaataaaatatttaatgg

SEQ ID NO: 2225 - DNA, 20 bp, Artificial sequence
  Synthetic oligonucleotide
gggcttattttttctagaga

SEQ ID NO: 2226 - DNA, 20 bp, Artificial sequence
  Synthetic oligonucleotide
acattatatatatgttggag

SEQ ID NO: 2227 - DNA, 20 bp, Artificial sequence
  Synthetic oligonucleotide
actggaattatccactctaa

SEQ ID NO: 2228 - DNA, 20 bp, Artificial sequence
  Synthetic oligonucleotide
attgtattaaccacgctttt

SEQ ID NO: 2229 - DNA, 20 bp, Artificial sequence
  Synthetic oligonucleotide
tagcagctatttcatgacta

SEQ ID NO: 2230 - DNA, 20 bp, Artificial sequence
  Synthetic oligonucleotide
gtgaacagccactacagagg

SEQ ID NO: 2231 - DNA, 20 bp, Artificial sequence
  Synthetic oligonucleotide
ccttcattctcaagctgaag

SEQ ID NO: 2232 - DNA, 20 bp, Artificial sequence
  Synthetic oligonucleotide
gatgtcagccgatttctgat

SEQ ID NO: 2233 - DNA, 20 bp, Artificial sequence
  Synthetic oligonucleotide
aggcatcctcaagagtctgt

SEQ ID NO: 2234 - DNA, 20 bp, Artificial sequence
  Synthetic oligonucleotide
gtacatgttcatcttaatgc

SEQ ID NO: 2235 - DNA, 20 bp, Artificial sequence
  Synthetic oligonucleotide
ggactctcaaccagaatcaa

SEQ ID NO: 2236 - DNA, 20 bp, Artificial sequence
  Synthetic oligonucleotide
gctgcctctccttccataaa

SEQ ID NO: 2237 - DNA, 20 bp, Artificial sequence
  Synthetic oligonucleotide
caatacattttacaactcca

SEQ ID NO: 2238 - DNA, 20 bp, Artificial sequence
  Synthetic oligonucleotide
ctgactctacaggctcatgt

SEQ ID NO: 2239 - DNA, 20 bp, Artificial sequence
  Synthetic oligonucleotide
ctgctttaaacaatagtctt

SEQ ID NO: 2240 - DNA, 20 bp, Artificial sequence
  Synthetic oligonucleotide
agggatggccaggaaggaca

SEQ ID NO: 2241 - DNA, 20 bp, Artificial sequence
  Synthetic oligonucleotide
atcagaaaaccccgtctcaa

SEQ ID NO: 2242 - DNA, 20 bp, Artificial sequence
  Synthetic oligonucleotide
tccctgttttcacaaattgc

SEQ ID NO: 2243 - DNA, 20 bp, Artificial sequence
  Synthetic oligonucleotide
ttcaataaaattcctttcac

SEQ ID NO: 2244 - DNA, 20 bp, Artificial sequence
  Synthetic oligonucleotide
atggcctttatacttttgta

SEQ ID NO: 2245 - DNA, 20 bp, Artificial sequence
  Synthetic oligonucleotide
acacattttccagaatggtt

SEQ ID NO: 2246 - DNA, 20 bp, Artificial sequence
  Synthetic oligonucleotide
cttttttatttacttgtata

SEQ ID NO: 2247 - DNA, 20 bp, Artificial sequence
  Synthetic oligonucleotide
cactgtccttttcagagaga

SEQ ID NO: 2248 - DNA, 20 bp, Artificial sequence
  Synthetic oligonucleotide
cttacatcacaaacatccca

SEQ ID NO: 2249 - DNA, 20 bp, Artificial sequence
  Synthetic oligonucleotide
ctaatgatacatttcaggct

SEQ ID NO: 2250 - DNA, 20 bp, Artificial sequence
  Synthetic oligonucleotide
atatatatcatcaaatctgt

SEQ ID NO: 2251 - DNA, 20 bp, Artificial sequence
  Synthetic oligonucleotide
ctcctcactaattagtgtga

SEQ ID NO: 2252 - DNA, 20 bp, Artificial sequence
  Synthetic oligonucleotide
gcctgccgaaaaattcacga

SEQ ID NO: 2253 - DNA, 20 bp, Artificial sequence
  Synthetic oligonucleotide
ccaaccagcctaaaaaattg

SEQ ID NO: 2254 - DNA, 20 bp, Artificial sequence
  Synthetic oligonucleotide
taggataattttatggcacc

SEQ ID NO: 2255 - DNA, 20 bp, Artificial sequence
  Synthetic oligonucleotide
caggcaatatttaattttct

SEQ ID NO: 2256 - DNA, 20 bp, Artificial sequence
  Synthetic oligonucleotide
ttgctgcaaatccaagtcat

SEQ ID NO: 2257 - DNA, 20 bp, Artificial sequence
  Synthetic oligonucleotide
tgccttatagccactcatac

SEQ ID NO: 2258 - DNA, 20 bp, Artificial sequence
  Synthetic oligonucleotide
tgagtacattcatatggcag

SEQ ID NO: 2259 - DNA, 20 bp, Artificial sequence
  Synthetic oligonucleotide
tggcgaattctatatggagc

SEQ ID NO: 2260 - DNA, 20 bp, Artificial sequence
  Synthetic oligonucleotide
agttgaatagacatggatta

SEQ ID NO: 2261 - DNA, 20 bp, Artificial sequence
  Synthetic oligonucleotide
actttcacaattttgcaaat

SEQ ID NO: 2262 - DNA, 20 bp, Artificial sequence
  Synthetic oligonucleotide
tctgaacaaaaatataagca

SEQ ID NO: 2263 - DNA, 20 bp, Artificial sequence
  Synthetic oligonucleotide
aaggtcatcaatattcaaaa

SEQ ID NO: 2264 - DNA, 20 bp, Artificial sequence
  Synthetic oligonucleotide
aggcttccctaaatgcaggc

SEQ ID NO: 2265 - DNA, 20 bp, Artificial sequence
  Synthetic oligonucleotide
ggccgtcggcctttgagtgc

SEQ ID NO: 2266 - DNA, 20 bp, Artificial sequence
  Synthetic oligonucleotide
aggcagagaaaaagagaccc

SEQ ID NO: 2267 - DNA, 20 bp, Artificial sequence
  Synthetic oligonucleotide
agtcatgaactataaacagt

SEQ ID NO: 2268 - DNA, 20 bp, Artificial sequence
  Synthetic oligonucleotide
ataattcacattcatccctt

SEQ ID NO: 2269 - DNA, 20 bp, Artificial sequence
  Synthetic oligonucleotide
aacataaccttataaaatgg

SEQ ID NO: 2270 - DNA, 20 bp, Artificial sequence
  Synthetic oligonucleotide
ttctccctacttataaaact

SEQ ID NO: 2271 - DNA, 20 bp, Artificial sequence
  Synthetic oligonucleotide
cgtttaaaaaatacagcact

SEQ ID NO: 2272 - DNA, 20 bp, Artificial sequence
  Synthetic oligonucleotide
gctttaactatatagcacac

SEQ ID NO: 2273 - DNA, 20 bp, Artificial sequence
  Synthetic oligonucleotide
gcctgctgttactagtttaa

SEQ ID NO: 2274 - DNA, 20 bp, Artificial sequence
  Synthetic oligonucleotide
aacacactcacctaacagaa

SEQ ID NO: 2275 - DNA, 20 bp, Artificial sequence
  Synthetic oligonucleotide
ctctgcttcctcacccatat

SEQ ID NO: 2276 - DNA, 20 bp, Artificial sequence
  Synthetic oligonucleotide
tgctttataaaaaagtatat

SEQ ID NO: 2277 - DNA, 20 bp, Artificial sequence
  Synthetic oligonucleotide
ttcaacagagccatatcttt

SEQ ID NO: 2278 - DNA, 20 bp, Artificial sequence
  Synthetic oligonucleotide
gtgttcaagattatattctt

SEQ ID NO: 2279 - DNA, 20 bp, Artificial sequence
  Synthetic oligonucleotide
gttagctaccagaacagttg

SEQ ID NO: 2280 - DNA, 20 bp, Artificial sequence
  Synthetic oligonucleotide
gtaaggattactgtaaacaa

SEQ ID NO: 2281 - DNA, 20 bp, Artificial sequence
  Synthetic oligonucleotide
caaaacatcattccttccct

SEQ ID NO: 2282 - DNA, 20 bp, Artificial sequence
  Synthetic oligonucleotide
cgagtgtatcctacaaatag

SEQ ID NO: 2283 - DNA, 20 bp, Artificial sequence
  Synthetic oligonucleotide
tgccagagaatttatatgta

SEQ ID NO: 2284 - DNA, 20 bp, Artificial sequence
  Synthetic oligonucleotide
cctgtcaaaaccagtcactc

SEQ ID NO: 2285 - DNA, 20 bp, Artificial sequence
  Synthetic oligonucleotide
ctaataatagtctaattaca

SEQ ID NO: 2286 - DNA, 20 bp, Artificial sequence
  Synthetic oligonucleotide
ttgtgcttttaaattcaaac

SEQ ID NO: 2287 - DNA, 20 bp, Artificial sequence
  Synthetic oligonucleotide
acatccttttaaatgttagg

SEQ ID NO: 2288 - DNA, 20 bp, Artificial sequence
  Synthetic oligonucleotide
tgtcttaatcaaacctcccg

SEQ ID NO: 2289 - DNA, 20 bp, Artificial sequence
  Synthetic oligonucleotide
cagttctatttttagttata

SEQ ID NO: 2290 - DNA, 20 bp, Artificial sequence
  Synthetic oligonucleotide
atttaccttctttaacacaa

SEQ ID NO: 2291 - DNA, 20 bp, Artificial sequence
  Synthetic oligonucleotide
gggatattttaaaattctac

SEQ ID NO: 2292 - DNA, 20 bp, Artificial sequence
  Synthetic oligonucleotide
cctgggtttcaaagattcct

SEQ ID NO: 2293 - DNA, 20 bp, Artificial sequence
  Synthetic oligonucleotide
tagagaattcaaagcaccaa

SEQ ID NO: 2294 - DNA, 20 bp, Artificial sequence
  Synthetic oligonucleotide
tcaaagttttaaagagtttt

SEQ ID NO: 2295 - DNA, 20 bp, Artificial sequence
  Synthetic oligonucleotide
tgctccaaacccagctcctc

SEQ ID NO: 2296 - DNA, 20 bp, Artificial sequence
  Synthetic oligonucleotide
ccctactccttttatagatg

SEQ ID NO: 2297 - DNA, 20 bp, Artificial sequence
  Synthetic oligonucleotide
tcatccaaacccagacgggt

SEQ ID NO: 2298 - DNA, 20 bp, Artificial sequence
  Synthetic oligonucleotide
ataaagtccttttaacccct

SEQ ID NO: 2299 - DNA, 20 bp, Artificial sequence
  Synthetic oligonucleotide
gtgcccttttaaaatctttt

SEQ ID NO: 2300 - DNA, 20 bp, Artificial sequence
  Synthetic oligonucleotide
agccaaaaatacatccacct

SEQ ID NO: 2301 - DNA, 20 bp, Artificial sequence
  Synthetic oligonucleotide
actgtaatctaaacaggcaa

SEQ ID NO: 2302 - DNA, 20 bp, Artificial sequence
  Synthetic oligonucleotide
ttcattacacacagcagaga

SEQ ID NO: 2303 - DNA, 20 bp, Artificial sequence
  Synthetic oligonucleotide
agacattatatatatgttgg

SEQ ID NO: 2304 - DNA, 20 bp, Artificial sequence
  Synthetic oligonucleotide
cccctacaccccagagcaca

SEQ ID NO: 2305 - DNA, 20 bp, Artificial sequence
  Synthetic oligonucleotide
gattgtattaaccacgcttt

SEQ ID NO: 2306 - DNA, 20 bp, Artificial sequence
  Synthetic oligonucleotide
tgaatgtcccaaatagcagc

SEQ ID NO: 2307 - DNA, 20 bp, Artificial sequence
  Synthetic oligonucleotide
cacccctaattcatgcagga

SEQ ID NO: 2308 - DNA, 20 bp, Artificial sequence
  Synthetic oligonucleotide
gccttcattctcaagctgaa

SEQ ID NO: 2309 - DNA, 20 bp, Artificial sequence
  Synthetic oligonucleotide
tttagctgtgatgatgtcag

SEQ ID NO: 2310 - DNA, 20 bp, Artificial sequence
  Synthetic oligonucleotide
tcaggcatcctcaagagtct

SEQ ID NO: 2311 - DNA, 20 bp, Artificial sequence
  Synthetic oligonucleotide
ctttagttcccatgaggtct

SEQ ID NO: 2312 - DNA, 20 bp, Artificial sequence
  Synthetic oligonucleotide
aagtggattatatttggcag

SEQ ID NO: 2313 - DNA, 20 bp, Artificial sequence
  Synthetic oligonucleotide
atcagctgcctctccttcca

SEQ ID NO: 2314 - DNA, 20 bp, Artificial sequence
  Synthetic oligonucleotide
ccaatacattttacaactcc

SEQ ID NO: 2315 - DNA, 20 bp, Artificial sequence
  Synthetic oligonucleotide
ggactgactctacaggctca

SEQ ID NO: 2316 - DNA, 20 bp, Artificial sequence
  Synthetic oligonucleotide
actgctttaaacaatagtct

SEQ ID NO: 2317 - DNA, 20 bp, Artificial sequence
  Synthetic oligonucleotide
tttttcttacacatggtagc

SEQ ID NO: 2318 - DNA, 20 bp, Artificial sequence
  Synthetic oligonucleotide
tcagcatgaaaaaaatcaga

SEQ ID NO: 2319 - DNA, 20 bp, Artificial sequence
  Synthetic oligonucleotide
agtccctgttttcacaaatt

SEQ ID NO: 2320 - DNA, 20 bp, Artificial sequence
  Synthetic oligonucleotide
gcttttaagaaaaattttag

SEQ ID NO: 2321 - DNA, 20 bp, Artificial sequence
  Synthetic oligonucleotide
ggatggcctttatacttttg

SEQ ID NO: 2322 - DNA, 20 bp, Artificial sequence
  Synthetic oligonucleotide
tcattttatgatcttgctgg

SEQ ID NO: 2323 - DNA, 20 bp, Artificial sequence
  Synthetic oligonucleotide
ctggttatcttcttatgcat

SEQ ID NO: 2324 - DNA, 20 bp, Artificial sequence
  Synthetic oligonucleotide
tttggaatcttttttgcctc

SEQ ID NO: 2325 - DNA, 20 bp, Artificial sequence
  Synthetic oligonucleotide
ctcttacatcacaaacatcc

SEQ ID NO: 2326 - DNA, 20 bp, Artificial sequence
  Synthetic oligonucleotide
gttcctaatgatacatttca

SEQ ID NO: 2327 - DNA, 20 bp, Artificial sequence
  Synthetic oligonucleotide
aatatatatcatcaaatctg

SEQ ID NO: 2328 - DNA, 20 bp, Artificial sequence
  Synthetic oligonucleotide
ttttctcctcactaattagt

SEQ ID NO: 2329 - DNA, 20 bp, Artificial sequence
  Synthetic oligonucleotide
agcctgccgaaaaattcacg

SEQ ID NO: 2330 - DNA, 20 bp, Artificial sequence
  Synthetic oligonucleotide
ccataaaaaccctccaacca

SEQ ID NO: 2331 - DNA, 20 bp, Artificial sequence
  Synthetic oligonucleotide
ctaggataattttatggcac

SEQ ID NO: 2332 - DNA, 20 bp, Artificial sequence
  Synthetic oligonucleotide
gcaggcaatatttaattttc

SEQ ID NO: 2333 - DNA, 20 bp, Artificial sequence
  Synthetic oligonucleotide
ggaaaccaatcccacatcaa

SEQ ID NO: 2334 - DNA, 20 bp, Artificial sequence
  Synthetic oligonucleotide
agtgtttgccttatagccac

SEQ ID NO: 2335 - DNA, 20 bp, Artificial sequence
  Synthetic oligonucleotide
ttgagtacattcatatggca

SEQ ID NO: 2336 - DNA, 20 bp, Artificial sequence
  Synthetic oligonucleotide
tgctaaagaaaaagaattgt

SEQ ID NO: 2337 - DNA, 20 bp, Artificial sequence
  Synthetic oligonucleotide
tttccagttgaatagacatg

SEQ ID NO: 2338 - DNA, 20 bp, Artificial sequence
  Synthetic oligonucleotide
aattactttcacaattttgc

SEQ ID NO: 2339 - DNA, 20 bp, Artificial sequence
  Synthetic oligonucleotide
ctctgaacaaaaatataagc

SEQ ID NO: 2340 - DNA, 20 bp, Artificial sequence
  Synthetic oligonucleotide
acacactataaatgaggctc

SEQ ID NO: 2341 - DNA, 20 bp, Artificial sequence
  Synthetic oligonucleotide
caggcttccctaaatgcagg

SEQ ID NO: 2342 - DNA, 20 bp, Artificial sequence
  Synthetic oligonucleotide
gctgcccgccaggccgtcgg

SEQ ID NO: 2343 - DNA, 20 bp, Artificial sequence
  Synthetic oligonucleotide
cccccccggcccatgccgat

SEQ ID NO: 2344 - DNA, 20 bp, Artificial sequence
  Synthetic oligonucleotide
tagtcatgaactataaacag

SEQ ID NO: 2345 - DNA, 20 bp, Artificial sequence
  Synthetic oligonucleotide
tcataattcacattcatccc

SEQ ID NO: 2346 - DNA, 20 bp, Artificial sequence
  Synthetic oligonucleotide
gaccaaaatgaattttcaaa

SEQ ID NO: 2347 - DNA, 20 bp, Artificial sequence
  Synthetic oligonucleotide
tatttaaaaatttctcccta

SEQ ID NO: 2348 - DNA, 20 bp, Artificial sequence
  Synthetic oligonucleotide
tcttaccatcaaaggctaaa

SEQ ID NO: 2349 - DNA, 20 bp, Artificial sequence
  Synthetic oligonucleotide
agctttaactatatagcaca

SEQ ID NO: 2350 - DNA, 20 bp, Artificial sequence
  Synthetic oligonucleotide
cctgactaatttcttggtga

SEQ ID NO: 2351 - DNA, 20 bp, Artificial sequence
  Synthetic oligonucleotide
aaaacccaacacactcacct

SEQ ID NO: 2352 - DNA, 20 bp, Artificial sequence
  Synthetic oligonucleotide
gacaaccaacacagctcaag

SEQ ID NO: 2353 - DNA, 20 bp, Artificial sequence
  Synthetic oligonucleotide
gtgctttataaaaaagtata

SEQ ID NO: 2354 - DNA, 20 bp, Artificial sequence
  Synthetic oligonucleotide
tcattgtttcaacagagcca

SEQ ID NO: 2355 - DNA, 20 bp, Artificial sequence
  Synthetic oligonucleotide
cgtgttcaagattatattct

SEQ ID NO: 2356 - DNA, 20 bp, Artificial sequence
  Synthetic oligonucleotide
agttagctaccagaacagtt

SEQ ID NO: 2357 - DNA, 20 bp, Artificial sequence
  Synthetic oligonucleotide
tgtcacctaatacttggtat

SEQ ID NO: 2358 - DNA, 20 bp, Artificial sequence
  Synthetic oligonucleotide
gtgcaaaacatcattccttc

SEQ ID NO: 2359 - DNA, 20 bp, Artificial sequence
  Synthetic oligonucleotide
aattcaataaacagactcga

SEQ ID NO: 2360 - DNA, 20 bp, Artificial sequence
  Synthetic oligonucleotide
ttcagaatttaaaattcagc

SEQ ID NO: 2361 - DNA, 20 bp, Artificial sequence
  Synthetic oligonucleotide
acaattagccaaaactgaat

SEQ ID NO: 2362 - DNA, 20 bp, Artificial sequence
  Synthetic oligonucleotide
cgttccaaattattcctgct

SEQ ID NO: 2363 - DNA, 20 bp, Artificial sequence
  Synthetic oligonucleotide
atttgctccttttatcattg

SEQ ID NO: 2364 - DNA, 20 bp, Artificial sequence
  Synthetic oligonucleotide
acattatttcaaaacccaca

SEQ ID NO: 2365 - DNA, 20 bp, Artificial sequence
  Synthetic oligonucleotide
tagtggttagattaacagct

SEQ ID NO: 2366 - DNA, 20 bp, Artificial sequence
  Synthetic oligonucleotide
gtctcataacgataaccaaa

SEQ ID NO: 2367 - DNA, 20 bp, Artificial sequence
  Synthetic oligonucleotide
acctttaaaattttttcagc

SEQ ID NO: 2368 - DNA, 20 bp, Artificial sequence
  Synthetic oligonucleotide
gcttacaaagccatagaacc

SEQ ID NO: 2369 - DNA, 20 bp, Artificial sequence
  Synthetic oligonucleotide
gtctacagcctttaacgact

SEQ ID NO: 2370 - DNA, 20 bp, Artificial sequence
  Synthetic oligonucleotide
ccagttaaccaaaaaatttt

SEQ ID NO: 2371 - DNA, 20 bp, Artificial sequence
  Synthetic oligonucleotide
ggctactatcaaatacattt

SEQ ID NO: 2372 - DNA, 20 bp, Artificial sequence
  Synthetic oligonucleotide
tgtttatttcaaactttccc

SEQ ID NO: 2373 - DNA, 20 bp, Artificial sequence
  Synthetic oligonucleotide
ggtcttggcccttaactgtt

SEQ ID NO: 2374 - DNA, 20 bp, Artificial sequence
  Synthetic oligonucleotide
ccctgataaatttatgaatt

SEQ ID NO: 2375 - DNA, 20 bp, Artificial sequence
  Synthetic oligonucleotide
tttgatctgccttatctctg

SEQ ID NO: 2376 - DNA, 20 bp, Artificial sequence
  Synthetic oligonucleotide
tttgtattttaaactgagtg

SEQ ID NO: 2377 - DNA, 20 bp, Artificial sequence
  Synthetic oligonucleotide
aagccaaaaatacatccacc

SEQ ID NO: 2378 - DNA, 20 bp, Artificial sequence
  Synthetic oligonucleotide
ctttttagaataccatgccc

SEQ ID NO: 2379 - DNA, 20 bp, Artificial sequence
  Synthetic oligonucleotide
aattcattacacacagcaga

SEQ ID NO: 2380 - DNA, 20 bp, Artificial sequence
  Synthetic oligonucleotide
aagacattatatatatgttg

SEQ ID NO: 2381 - DNA, 20 bp, Artificial sequence
  Synthetic oligonucleotide
aaggacagcccctacacccc

SEQ ID NO: 2382 - DNA, 20 bp, Artificial sequence
  Synthetic oligonucleotide
cagattgtattaaccacgct

SEQ ID NO: 2383 - DNA, 20 bp, Artificial sequence
  Synthetic oligonucleotide
tgttttattttatctgaatg

SEQ ID NO: 2384 - DNA, 20 bp, Artificial sequence
  Synthetic oligonucleotide
ccacccctaattcatgcagg

SEQ ID NO: 2385 - DNA, 20 bp, Artificial sequence
  Synthetic oligonucleotide
gctgccttcattctcaagct

SEQ ID NO: 2386 - DNA, 20 bp, Artificial sequence
  Synthetic oligonucleotide
ggtggagtattttagctgtg

SEQ ID NO: 2387 - DNA, 20 bp, Artificial sequence
  Synthetic oligonucleotide
ttatgagttcaggcatcctc

SEQ ID NO: 2388 - DNA, 20 bp, Artificial sequence
  Synthetic oligonucleotide
ggctttagttcccatgaggt

SEQ ID NO: 2389 - DNA, 20 bp, Artificial sequence
  Synthetic oligonucleotide
ttaagtggattatatttggc

SEQ ID NO: 2390 - DNA, 20 bp, Artificial sequence
  Synthetic oligonucleotide
ctagactttcatcagctgcc

SEQ ID NO: 2391 - DNA, 20 bp, Artificial sequence
  Synthetic oligonucleotide
accaatacattttacaactc

SEQ ID NO: 2392 - DNA, 20 bp, Artificial sequence
  Synthetic oligonucleotide
aagggactgactctacaggc

SEQ ID NO: 2393 - DNA, 20 bp, Artificial sequence
  Synthetic oligonucleotide
gacctctctctacttgctgt

SEQ ID NO: 2394 - DNA, 20 bp, Artificial sequence
  Synthetic oligonucleotide
tgggtttttcttacacatgg

SEQ ID NO: 2395 - DNA, 20 bp, Artificial sequence
  Synthetic oligonucleotide
gtcttgttttacctgtagag

SEQ ID NO: 2396 - DNA, 20 bp, Artificial sequence
  Synthetic oligonucleotide
catttccttcacaagagtcc

SEQ ID NO: 2397 - DNA, 20 bp, Artificial sequence
  Synthetic oligonucleotide
cctaatctgactaatgactg

SEQ ID NO: 2398 - DNA, 20 bp, Artificial sequence
  Synthetic oligonucleotide
agggatggcctttatacttt

SEQ ID NO: 2399 - DNA, 20 bp, Artificial sequence
  Synthetic oligonucleotide
aatcattaagtcattttatg

SEQ ID NO: 2400 - DNA, 20 bp, Artificial sequence
  Synthetic oligonucleotide
actggttatcttcttatgca

SEQ ID NO: 2401 - DNA, 20 bp, Artificial sequence
  Synthetic oligonucleotide
actctctccattcatttgga

SEQ ID NO: 2402 - DNA, 20 bp, Artificial sequence
  Synthetic oligonucleotide
tctcttacatcacaaacatc

SEQ ID NO: 2403 - DNA, 20 bp, Artificial sequence
  Synthetic oligonucleotide
tgagggttcctaatgataca

SEQ ID NO: 2404 - DNA, 20 bp, Artificial sequence
  Synthetic oligonucleotide
gtgagaatatatatcatcaa

SEQ ID NO: 2405 - DNA, 20 bp, Artificial sequence
  Synthetic oligonucleotide
cttgccagcccaatgctagt

SEQ ID NO: 2406 - DNA, 20 bp, Artificial sequence
  Synthetic oligonucleotide
catagctagaacagcctgcc

SEQ ID NO: 2407 - DNA, 20 bp, Artificial sequence
  Synthetic oligonucleotide
cccataaaaaccctccaacc

SEQ ID NO: 2408 - DNA, 20 bp, Artificial sequence
  Synthetic oligonucleotide
gctaggataattttatggca

SEQ ID NO: 2409 - DNA, 20 bp, Artificial sequence
  Synthetic oligonucleotide
tatacacacttcacagggca

SEQ ID NO: 2410 - DNA, 20 bp, Artificial sequence
  Synthetic oligonucleotide
cagaaggaaaccaatcccac

SEQ ID NO: 2411 - DNA, 20 bp, Artificial sequence
  Synthetic oligonucleotide
cagtgtttgccttatagcca

SEQ ID NO: 2412 - DNA, 20 bp, Artificial sequence
  Synthetic oligonucleotide
aacttgagtacattcatatg

SEQ ID NO: 2413 - DNA, 20 bp, Artificial sequence
  Synthetic oligonucleotide
tggaatatctttacagtgct

SEQ ID NO: 2414 - DNA, 20 bp, Artificial sequence
  Synthetic oligonucleotide
cactgaaatcaagaatgcaa

SEQ ID NO: 2415 - DNA, 20 bp, Artificial sequence
  Synthetic oligonucleotide
tgaattactttcacaatttt

SEQ ID NO: 2416 - DNA, 20 bp, Artificial sequence
  Synthetic oligonucleotide
aactctgaacaaaaatataa

SEQ ID NO: 2417 - DNA, 20 bp, Artificial sequence
  Synthetic oligonucleotide
agccacacactataaatgag

SEQ ID NO: 2418 - DNA, 20 bp, Artificial sequence
  Synthetic oligonucleotide
ccaggcttccctaaatgcag

SEQ ID NO: 2419 - DNA, 20 bp, Artificial sequence
  Synthetic oligonucleotide
attccgttttcctgctcggc

SEQ ID NO: 2420 - DNA, 20 bp, Artificial sequence
  Synthetic oligonucleotide
ctgctctgaacccccccggc

SEQ ID NO: 2421 - DNA, 20 bp, Artificial sequence
  Synthetic oligonucleotide
ttgtccatagtcatgaacta

SEQ ID NO: 2422 - DNA, 20 bp, Artificial sequence
  Synthetic oligonucleotide
ttcataattcacattcatcc

SEQ ID NO: 2423 - DNA, 20 bp, Artificial sequence
  Synthetic oligonucleotide
gatgtggtaaaaagaccaaa

SEQ ID NO: 2424 - DNA, 20 bp, Artificial sequence
  Synthetic oligonucleotide
atatttaaaaatttctccct

SEQ ID NO: 2425 - DNA, 20 bp, Artificial sequence
  Synthetic oligonucleotide
cctcttaccatcaaaggcta

SEQ ID NO: 2426 - DNA, 20 bp, Artificial sequence
  Synthetic oligonucleotide
gagctttaactatatagcac

SEQ ID NO: 2427 - DNA, 20 bp, Artificial sequence
  Synthetic oligonucleotide
ttcgccctgactaatttctt

SEQ ID NO: 2428 - DNA, 20 bp, Artificial sequence
  Synthetic oligonucleotide
ggatgctgccacttcctggt

SEQ ID NO: 2429 - DNA, 20 bp, Artificial sequence
  Synthetic oligonucleotide
ccatgacaaccaacacagct

SEQ ID NO: 2430 - DNA, 20 bp, Artificial sequence
  Synthetic oligonucleotide
ccaacccaacacaatagcag

SEQ ID NO: 2431 - DNA, 20 bp, Artificial sequence
  Synthetic oligonucleotide
actcattgtttcaacagagc

SEQ ID NO: 2432 - DNA, 20 bp, Artificial sequence
  Synthetic oligonucleotide
cccttgttacaaacacttcg

SEQ ID NO: 2433 - DNA, 20 bp, Artificial sequence
  Synthetic oligonucleotide
ccctcccgccattacacagg

SEQ ID NO: 2434 - DNA, 20 bp, Artificial sequence
  Synthetic oligonucleotide
tagtgtcacctaatacttgg

SEQ ID NO: 2435 - DNA, 20 bp, Artificial sequence
  Synthetic oligonucleotide
ggtgcaaaacatcattcctt

SEQ ID NO: 2436 - DNA, 20 bp, Artificial sequence
  Synthetic oligonucleotide
ccataaaattcaataaacag

SEQ ID NO: 2437 - DNA, 20 bp, Artificial sequence
  Synthetic oligonucleotide
ataagctttctttaaatgca

SEQ ID NO: 2438 - DNA, 20 bp, Artificial sequence
  Synthetic oligonucleotide
gtgttctttctttaacagtt

SEQ ID NO: 2439 - DNA, 20 bp, Artificial sequence
  Synthetic oligonucleotide
cccccgttccaaattattcc

SEQ ID NO: 2440 - DNA, 20 bp, Artificial sequence
  Synthetic oligonucleotide
gtttttatccattacaagag

SEQ ID NO: 2441 - DNA, 20 bp, Artificial sequence
  Synthetic oligonucleotide
acccgcaatcaaatactgcc

SEQ ID NO: 2442 - DNA, 20 bp, Artificial sequence
  Synthetic oligonucleotide
ctaatgtgcccttaacatgg

SEQ ID NO: 2443 - DNA, 20 bp, Artificial sequence
  Synthetic oligonucleotide
gctcataaaaccatgtgctc

SEQ ID NO: 2444 - DNA, 20 bp, Artificial sequence
  Synthetic oligonucleotide
gcttgattttaaactttata

SEQ ID NO: 2445 - DNA, 20 bp, Artificial sequence
  Synthetic oligonucleotide
accctcaaacgaataggctc

SEQ ID NO: 2446 - DNA, 20 bp, Artificial sequence
  Synthetic oligonucleotide
tccacacaagaataatctac

SEQ ID NO: 2447 - DNA, 20 bp, Artificial sequence
  Synthetic oligonucleotide
gctaggaaaatttaccatac

SEQ ID NO: 2448 - DNA, 20 bp, Artificial sequence
  Synthetic oligonucleotide
gattaaataatttaagcaca

SEQ ID NO: 2449 - DNA, 20 bp, Artificial sequence
  Synthetic oligonucleotide
tcttgggttccttatattac

SEQ ID NO: 2450 - DNA, 20 bp, Artificial sequence
  Synthetic oligonucleotide
taggtgtttatttagaaccc

SEQ ID NO: 2451 - DNA, 20 bp, Artificial sequence
  Synthetic oligonucleotide
tcatgctttcaaaacacagt

SEQ ID NO: 2452 - DNA, 20 bp, Artificial sequence
  Synthetic oligonucleotide
aatgaaatcatttactgaac

SEQ ID NO: 2453 - DNA, 20 bp, Artificial sequence
  Synthetic oligonucleotide
agtgtaatacattactcata

SEQ ID NO: 2454 - DNA, 20 bp, Artificial sequence
  Synthetic oligonucleotide
gtatacaaagatataacctg

SEQ ID NO: 2455 - DNA, 20 bp, Artificial sequence
  Synthetic oligonucleotide
tgtttgttttaaaattaggg

SEQ ID NO: 2456 - DNA, 20 bp, Artificial sequence
  Synthetic oligonucleotide
ggttaattcattacacacag

SEQ ID NO: 2457 - DNA, 20 bp, Artificial sequence
  Synthetic oligonucleotide
acctaaataataagacatta

SEQ ID NO: 2458 - DNA, 20 bp, Artificial sequence
  Synthetic oligonucleotide
agccagacaactaaggacag

SEQ ID NO: 2459 - DNA, 20 bp, Artificial sequence
  Synthetic oligonucleotide
tcagattgtattaaccacgc

SEQ ID NO: 2460 - DNA, 20 bp, Artificial sequence
  Synthetic oligonucleotide
ttgttttattttatctgaat

SEQ ID NO: 2461 - DNA, 20 bp, Artificial sequence
  Synthetic oligonucleotide
gtacccacccctaattcatg

SEQ ID NO: 2462 - DNA, 20 bp, Artificial sequence
  Synthetic oligonucleotide
tggctgccttcattctcaag

SEQ ID NO: 2463 - DNA, 20 bp, Artificial sequence
  Synthetic oligonucleotide
tgtggcaaacacagctggtg

SEQ ID NO: 2464 - DNA, 20 bp, Artificial sequence
  Synthetic oligonucleotide
atactatatcacactgcttt

SEQ ID NO: 2465 - DNA, 20 bp, Artificial sequence
  Synthetic oligonucleotide
gttttatatgccatggcttt

SEQ ID NO: 2466 - DNA, 20 bp, Artificial sequence
  Synthetic oligonucleotide
tggaggatattaagtggatt

SEQ ID NO: 2467 - DNA, 20 bp, Artificial sequence
  Synthetic oligonucleotide
tctagactttcatcagctgc

SEQ ID NO: 2468 - DNA, 20 bp, Artificial sequence
  Synthetic oligonucleotide
ttaccaatacattttacaac

SEQ ID NO: 2469 - DNA, 20 bp, Artificial sequence
  Synthetic oligonucleotide
ggcatgttcaatgttggcaa

SEQ ID NO: 2470 - DNA, 20 bp, Artificial sequence
  Synthetic oligonucleotide
acagggaaaactgttaggtg

SEQ ID NO: 2471 - DNA, 20 bp, Artificial sequence
  Synthetic oligonucleotide
ctgggtttttcttacacatg

SEQ ID NO: 2472 - DNA, 20 bp, Artificial sequence
  Synthetic oligonucleotide
cagtcttgttttacctgtag

SEQ ID NO: 2473 - DNA, 20 bp, Artificial sequence
  Synthetic oligonucleotide
ctcccatttccttcacaaga

SEQ ID NO: 2474 - DNA, 20 bp, Artificial sequence
  Synthetic oligonucleotide
gtcaccttcctaatctgact

SEQ ID NO: 2475 - DNA, 20 bp, Artificial sequence
  Synthetic oligonucleotide
cctttataacttttctttct

SEQ ID NO: 2476 - DNA, 20 bp, Artificial sequence
  Synthetic oligonucleotide
gttagtaatcattaagtcat

SEQ ID NO: 2477 - DNA, 20 bp, Artificial sequence
  Synthetic oligonucleotide
ccctggtgccaaaagggact

SEQ ID NO: 2478 - DNA, 20 bp, Artificial sequence
  Synthetic oligonucleotide
tctttaacccctcttgcgcc

SEQ ID NO: 2479 - DNA, 20 bp, Artificial sequence
  Synthetic oligonucleotide
tttctcttacatcacaaaca

SEQ ID NO: 2480 - DNA, 20 bp, Artificial sequence
  Synthetic oligonucleotide
ttgagggttcctaatgatac

SEQ ID NO: 2481 - DNA, 20 bp, Artificial sequence
  Synthetic oligonucleotide
agtgagaatatatatcatca

SEQ ID NO: 2482 - DNA, 20 bp, Artificial sequence
  Synthetic oligonucleotide
aatctgatcattgtaggcac

SEQ ID NO: 2483 - DNA, 20 bp, Artificial sequence
  Synthetic oligonucleotide
tggtgtgaaccatagctaga

SEQ ID NO: 2484 - DNA, 20 bp, Artificial sequence
  Synthetic oligonucleotide
acccccctcccataaaaacc

SEQ ID NO: 2485 - DNA, 20 bp, Artificial sequence
  Synthetic oligonucleotide
ggttttaccctttcctgcac

SEQ ID NO: 2486 - DNA, 20 bp, Artificial sequence
  Synthetic oligonucleotide
cacattatacacacttcaca

SEQ ID NO: 2487 - DNA, 20 bp, Artificial sequence
  Synthetic oligonucleotide
tcattaacaacataaactga

SEQ ID NO: 2488 - DNA, 20 bp, Artificial sequence
  Synthetic oligonucleotide
catggtacagataattgtga

SEQ ID NO: 2489 - DNA, 20 bp, Artificial sequence
  Synthetic oligonucleotide
tactggatccatacaaggca

SEQ ID NO: 2490 - DNA, 20 bp, Artificial sequence
  Synthetic oligonucleotide
atggaatatctttacagtgc

SEQ ID NO: 2491 - DNA, 20 bp, Artificial sequence
  Synthetic oligonucleotide
ccactgaaatcaagaatgca

SEQ ID NO: 2492 - DNA, 20 bp, Artificial sequence
  Synthetic oligonucleotide
tcttgaattactttcacaat

SEQ ID NO: 2493 - DNA, 20 bp, Artificial sequence
  Synthetic oligonucleotide
gaggacaactaaaaactctg

SEQ ID NO: 2494 - DNA, 20 bp, Artificial sequence
  Synthetic oligonucleotide
cagccacacactataaatga

SEQ ID NO: 2495 - DNA, 20 bp, Artificial sequence
  Synthetic oligonucleotide
gccaggcttccctaaatgca

SEQ ID NO: 2496 - DNA, 20 bp, Artificial sequence
  Synthetic oligonucleotide
tcgccattctcagagagcat

SEQ ID NO: 2497 - DNA, 20 bp, Artificial sequence
  Synthetic oligonucleotide
tgggaaccccaggaggacac

SEQ ID NO: 2498 - DNA, 20 bp, Artificial sequence
  Synthetic oligonucleotide
atctaattcctcatgtcaca

SEQ ID NO: 2499 - DNA, 20 bp, Artificial sequence
  Synthetic oligonucleotide
gttcataattcacattcatc

SEQ ID NO: 2500 - DNA, 20 bp, Artificial sequence
  Synthetic oligonucleotide
cagagtttctaagagcccgc

SEQ ID NO: 2501 - DNA, 20 bp, Artificial sequence
  Synthetic oligonucleotide
aatatttaaaaatttctccc

SEQ ID NO: 2502 - DNA, 20 bp, Artificial sequence
  Synthetic oligonucleotide
ttcctcttaccatcaaaggc

SEQ ID NO: 2503 - DNA, 20 bp, Artificial sequence
  Synthetic oligonucleotide
atgagctttaactatatagc

SEQ ID NO: 2504 - DNA, 20 bp, Artificial sequence
  Synthetic oligonucleotide
tcttttcgccctgactaatt

SEQ ID NO: 2505 - DNA, 20 bp, Artificial sequence
  Synthetic oligonucleotide
aagaggtgtgaaaggttccg

SEQ ID NO: 2506 - DNA, 20 bp, Artificial sequence
  Synthetic oligonucleotide
gccatgacaaccaacacagc

SEQ ID NO: 2507 - DNA, 20 bp, Artificial sequence
  Synthetic oligonucleotide
ggaaaccaacccaacacaat

SEQ ID NO: 2508 - DNA, 20 bp, Artificial sequence
  Synthetic oligonucleotide
actttcaacccttctctgct

SEQ ID NO: 2509 - DNA, 20 bp, Artificial sequence
  Synthetic oligonucleotide
atcccttgttacaaacactt

SEQ ID NO: 2510 - DNA, 20 bp, Artificial sequence
  Synthetic oligonucleotide
tccctcccgccattacacag

SEQ ID NO: 2511 - DNA, 20 bp, Artificial sequence
  Synthetic oligonucleotide
tgagctagtgtcacctaata

SEQ ID NO: 2512 - DNA, 20 bp, Artificial sequence
  Synthetic oligonucleotide
aggtgcaaaacatcattcct

SEQ ID NO: 2513 - DNA, 20 bp, Artificial sequence
  Synthetic oligonucleotide
agggaccataaaattcaata

SEQ ID NO: 2514 - DNA, 20 bp, Artificial sequence
  Synthetic oligonucleotide
ctcctccaaatttatcttca

SEQ ID NO: 2515 - DNA, 20 bp, Artificial sequence
  Synthetic oligonucleotide
cacaaaatacattaagtcct

SEQ ID NO: 2516 - DNA, 20 bp, Artificial sequence
  Synthetic oligonucleotide
tccagcaaaatatttcttta

SEQ ID NO: 2517 - DNA, 20 bp, Artificial sequence
  Synthetic oligonucleotide
ttgatcaaccaaagatggct

SEQ ID NO: 2518 - DNA, 20 bp, Artificial sequence
  Synthetic oligonucleotide
ccaatggctttttaacagat

SEQ ID NO: 2519 - DNA, 20 bp, Artificial sequence
  Synthetic oligonucleotide
aacacattagattatgagta

SEQ ID NO: 2520 - DNA, 20 bp, Artificial sequence
  Synthetic oligonucleotide
agggtgttattttagagtaa

SEQ ID NO: 2521 - DNA, 20 bp, Artificial sequence
  Synthetic oligonucleotide
gctggaaaagaatctgagca

SEQ ID NO: 2522 - DNA, 20 bp, Artificial sequence
  Synthetic oligonucleotide
gttatattattttatccctt

SEQ ID NO: 2523 - DNA, 20 bp, Artificial sequence
  Synthetic oligonucleotide
gaagatatcttttatgacac

SEQ ID NO: 2524 - DNA, 20 bp, Artificial sequence
  Synthetic oligonucleotide
cacagtagccaaaagcagtc

SEQ ID NO: 2525 - DNA, 20 bp, Artificial sequence
  Synthetic oligonucleotide
gtatatattatttaaaatgt

SEQ ID NO: 2526 - DNA, 20 bp, Artificial sequence
  Synthetic oligonucleotide
agctggtttctttagccacc

SEQ ID NO: 2527 - DNA, 20 bp, Artificial sequence
  Synthetic oligonucleotide
gactgaaaaatacccagcca

SEQ ID NO: 2528 - DNA, 20 bp, Artificial sequence
  Synthetic oligonucleotide
taggccttattttattccat

SEQ ID NO: 2529 - DNA, 20 bp, Artificial sequence
  Synthetic oligonucleotide
tgagctttttaaaaacagtt

SEQ ID NO: 2530 - DNA, 20 bp, Artificial sequence
  Synthetic oligonucleotide
tttcttagccaaagagatat

SEQ ID NO: 2531 - DNA, 20 bp, Artificial sequence
  Synthetic oligonucleotide
tgttcaatttaaaagccttg

SEQ ID NO: 2532 - DNA, 20 bp, Artificial sequence
  Synthetic oligonucleotide
atctgcaaagaatctgcccc

SEQ ID NO: 2533 - DNA, 20 bp, Artificial sequence
  Synthetic oligonucleotide
aggttaattcattacacaca

SEQ ID NO: 2534 - DNA, 20 bp, Artificial sequence
  Synthetic oligonucleotide
tcatacctaaataataagac

SEQ ID NO: 2535 - DNA, 20 bp, Artificial sequence
  Synthetic oligonucleotide
cagccagacaactaaggaca

SEQ ID NO: 2536 - DNA, 20 bp, Artificial sequence
  Synthetic oligonucleotide
cctgacttctcagattgtat

SEQ ID NO: 2537 - DNA, 20 bp, Artificial sequence
  Synthetic oligonucleotide
attcaaaccattaattagtt

SEQ ID NO: 2538 - DNA, 20 bp, Artificial sequence
  Synthetic oligonucleotide
agtacccacccctaattcat

SEQ ID NO: 2539 - DNA, 20 bp, Artificial sequence
  Synthetic oligonucleotide
agtggctgccttcattctca

SEQ ID NO: 2540 - DNA, 20 bp, Artificial sequence
  Synthetic oligonucleotide
gactctgaacctgtcacttg

SEQ ID NO: 2541 - DNA, 20 bp, Artificial sequence
  Synthetic oligonucleotide
ccatactatatcacactgct

SEQ ID NO: 2542 - DNA, 20 bp, Artificial sequence
  Synthetic oligonucleotide
ctcagttttatatgccatgg

SEQ ID NO: 2543 - DNA, 20 bp, Artificial sequence
  Synthetic oligonucleotide
ttggaggatattaagtggat

SEQ ID NO: 2544 - DNA, 20 bp, Artificial sequence
  Synthetic oligonucleotide
ttctagactttcatcagctg

SEQ ID NO: 2545 - DNA, 20 bp, Artificial sequence
  Synthetic oligonucleotide
ctttaccaatacattttaca

SEQ ID NO: 2546 - DNA, 20 bp, Artificial sequence
  Synthetic oligonucleotide
attcatcgccaccaagctcg

SEQ ID NO: 2547 - DNA, 20 bp, Artificial sequence
  Synthetic oligonucleotide
atctatcacaccaatgcaag

SEQ ID NO: 2548 - DNA, 20 bp, Artificial sequence
  Synthetic oligonucleotide
gctgggtttttcttacacat

SEQ ID NO: 2549 - DNA, 20 bp, Artificial sequence
  Synthetic oligonucleotide
agtgaaattctcagtcttgt

SEQ ID NO: 2550 - DNA, 20 bp, Artificial sequence
  Synthetic oligonucleotide
gttgtttaaatatgtctccc

SEQ ID NO: 2551 - DNA, 20 bp, Artificial sequence
  Synthetic oligonucleotide
tgtcaccttcctaatctgac

SEQ ID NO: 2552 - DNA, 20 bp, Artificial sequence
  Synthetic oligonucleotide
gcctttataacttttctttc

SEQ ID NO: 2553 - DNA, 20 bp, Artificial sequence
  Synthetic oligonucleotide
tgttagtaatcattaagtca

SEQ ID NO: 2554 - DNA, 20 bp, Artificial sequence
  Synthetic oligonucleotide
ccaaaaaatcttcttccatg

SEQ ID NO: 2555 - DNA, 20 bp, Artificial sequence
  Synthetic oligonucleotide
ttctttaacccctcttgcgc

SEQ ID NO: 2556 - DNA, 20 bp, Artificial sequence
  Synthetic oligonucleotide
cttggaatcatactttcttc

SEQ ID NO: 2557 - DNA, 20 bp, Artificial sequence
  Synthetic oligonucleotide
attgagggttcctaatgata

SEQ ID NO: 2558 - DNA, 20 bp, Artificial sequence
  Synthetic oligonucleotide
tcagtgagaatatatatcat

SEQ ID NO: 2559 - DNA, 20 bp, Artificial sequence
  Synthetic oligonucleotide
cagataatctgatcattgta

SEQ ID NO: 2560 - DNA, 20 bp, Artificial sequence
  Synthetic oligonucleotide
gtggtgtgaaccatagctag

SEQ ID NO: 2561 - DNA, 20 bp, Artificial sequence
  Synthetic oligonucleotide
ccccccatacccccctccca

SEQ ID NO: 2562 - DNA, 20 bp, Artificial sequence
  Synthetic oligonucleotide
gggttttaccctttcctgca

SEQ ID NO: 2563 - DNA, 20 bp, Artificial sequence
  Synthetic oligonucleotide
gccacattatacacacttca

SEQ ID NO: 2564 - DNA, 20 bp, Artificial sequence
  Synthetic oligonucleotide
gtcattaacaacataaactg

SEQ ID NO: 2565 - DNA, 20 bp, Artificial sequence
  Synthetic oligonucleotide
ccatggtacagataattgtg

SEQ ID NO: 2566 - DNA, 20 bp, Artificial sequence
  Synthetic oligonucleotide
ctgatacatttctagaatga

SEQ ID NO: 2567 - DNA, 20 bp, Artificial sequence
  Synthetic oligonucleotide
tcacagtttacatctcaaca

SEQ ID NO: 2568 - DNA, 20 bp, Artificial sequence
  Synthetic oligonucleotide
tagaattaaaatatacacca

SEQ ID NO: 2569 - DNA, 20 bp, Artificial sequence
  Synthetic oligonucleotide
gtcttgaattactttcacaa

SEQ ID NO: 2570 - DNA, 20 bp, Artificial sequence
  Synthetic oligonucleotide
tggaccaaccctccttctga

SEQ ID NO: 2571 - DNA, 20 bp, Artificial sequence
  Synthetic oligonucleotide
tcccccagccacacactata

SEQ ID NO: 2572 - DNA, 20 bp, Artificial sequence
  Synthetic oligonucleotide
tcaggtagccgatgacaggg

SEQ ID NO: 2573 - DNA, 20 bp, Artificial sequence
  Synthetic oligonucleotide
ttcgccattctcagagagca

SEQ ID NO: 2574 - DNA, 20 bp, Artificial sequence
  Synthetic oligonucleotide
gctgggttcctgatgttgat

SEQ ID NO: 2575 - DNA, 20 bp, Artificial sequence
  Synthetic oligonucleotide
aatctaattcctcatgtcac

SEQ ID NO: 2576 - DNA, 20 bp, Artificial sequence
  Synthetic oligonucleotide
agttcataattcacattcat

SEQ ID NO: 2577 - DNA, 20 bp, Artificial sequence
  Synthetic oligonucleotide
tcagagtttctaagagcccg

SEQ ID NO: 2578 - DNA, 20 bp, Artificial sequence
  Synthetic oligonucleotide
gcagccatccaagtaagaat

SEQ ID NO: 2579 - DNA, 20 bp, Artificial sequence
  Synthetic oligonucleotide
gcccgtattcctcttaccat

SEQ ID NO: 2580 - DNA, 20 bp, Artificial sequence
  Synthetic oligonucleotide
ggaagatcaaccaaacaagg

SEQ ID NO: 2581 - DNA, 20 bp, Artificial sequence
  Synthetic oligonucleotide
gtattatttttttcttttcg

SEQ ID NO: 2582 - DNA, 20 bp, Artificial sequence
  Synthetic oligonucleotide
cagagcagtcaaagtgctgc

SEQ ID NO: 2583 - DNA, 20 bp, Artificial sequence
  Synthetic oligonucleotide
agccatgacaaccaacacag

SEQ ID NO: 2584 - DNA, 20 bp, Artificial sequence
  Synthetic oligonucleotide
aagagaggaaaccaacccaa

SEQ ID NO: 2585 - DNA, 20 bp, Artificial sequence
  Synthetic oligonucleotide
aactttcaacccttctctgc

SEQ ID NO: 2586 - DNA, 20 bp, Artificial sequence
  Synthetic oligonucleotide
ataatgagtcctgtttgatt

SEQ ID NO: 2587 - DNA, 20 bp, Artificial sequence
  Synthetic oligonucleotide
ccggtgttccctcccgccat

SEQ ID NO: 2588 - DNA, 20 bp, Artificial sequence
  Synthetic oligonucleotide
cagagaaaacctgtgcaccg

SEQ ID NO: 2589 - DNA, 20 bp, Artificial sequence
  Synthetic oligonucleotide
aaggtgcaaaacatcattcc

SEQ ID NO: 2590 - DNA, 20 bp, Artificial sequence
  Synthetic oligonucleotide
aagcaccatcaaagaaaggg

SEQ ID NO: 2591 - DNA, 20 bp, Artificial sequence
  Synthetic oligonucleotide
acccaatttcaaagatcact

SEQ ID NO: 2592 - DNA, 20 bp, Artificial sequence
  Synthetic oligonucleotide
gttcacaaaatacattaagt

SEQ ID NO: 2593 - DNA, 20 bp, Artificial sequence
  Synthetic oligonucleotide
agatcaattcaaaggctcct

SEQ ID NO: 2594 - DNA, 20 bp, Artificial sequence
  Synthetic oligonucleotide
gatttgtatttttaattgac

SEQ ID NO: 2595 - DNA, 20 bp, Artificial sequence
  Synthetic oligonucleotide
ttgacattttaaaacagctc

SEQ ID NO: 2596 - DNA, 20 bp, Artificial sequence
  Synthetic oligonucleotide
aagcttatccaaaaacattt

SEQ ID NO: 2597 - DNA, 20 bp, Artificial sequence
  Synthetic oligonucleotide
cccctcaaccaaacttttac

SEQ ID NO: 2598 - DNA, 20 bp, Artificial sequence
  Synthetic oligonucleotide
tattaatttcattaccatga

SEQ ID NO: 2599 - DNA, 20 bp, Artificial sequence
  Synthetic oligonucleotide
cctagaatacattattcctc

SEQ ID NO: 2600 - DNA, 20 bp, Artificial sequence
  Synthetic oligonucleotide
agcatattttaaagaagaag

SEQ ID NO: 2601 - DNA, 20 bp, Artificial sequence
  Synthetic oligonucleotide
gtccatacaccttaataagt

SEQ ID NO: 2602 - DNA, 20 bp, Artificial sequence
  Synthetic oligonucleotide
gattacttttaaaagcaaca

SEQ ID NO: 2603 - DNA, 20 bp, Artificial sequence
  Synthetic oligonucleotide
cctaaaagaatttatccata

SEQ ID NO: 2604 - DNA, 20 bp, Artificial sequence
  Synthetic oligonucleotide
cttggcaaattattatctgc

SEQ ID NO: 2605 - DNA, 20 bp, Artificial sequence
  Synthetic oligonucleotide
gctaagaaaatataggcctt

SEQ ID NO: 2606 - DNA, 20 bp, Artificial sequence
  Synthetic oligonucleotide
ggctttatagtctaagttgc

SEQ ID NO: 2607 - DNA, 20 bp, Artificial sequence
  Synthetic oligonucleotide
acttcaaacctttatcagtt

SEQ ID NO: 2608 - DNA, 20 bp, Artificial sequence
  Synthetic oligonucleotide
caaacccaaatttagctctg

SEQ ID NO: 2609 - DNA, 20 bp, Artificial sequence
  Synthetic oligonucleotide
cctttaagcccttaaagctg

SEQ ID NO: 2610 - DNA, 20 bp, Artificial sequence
  Synthetic oligonucleotide
gaggttaattcattacacac

SEQ ID NO: 2611 - DNA, 20 bp, Artificial sequence
  Synthetic oligonucleotide
ggccttatcatacctaaata

SEQ ID NO: 2612 - DNA, 20 bp, Artificial sequence
  Synthetic oligonucleotide
accagcagccagacaactaa

SEQ ID NO: 2613 - DNA, 20 bp, Artificial sequence
  Synthetic oligonucleotide
taccccaagcccagcaggtc

SEQ ID NO: 2614 - DNA, 20 bp, Artificial sequence
  Synthetic oligonucleotide
ccaaaacaattcaaaccatt

SEQ ID NO: 2615 - DNA, 20 bp, Artificial sequence
  Synthetic oligonucleotide
tttctcctagtacccacccc

SEQ ID NO: 2616 - DNA, 20 bp, Artificial sequence
  Synthetic oligonucleotide
aagtggctgccttcattctc

SEQ ID NO: 2617 - DNA, 20 bp, Artificial sequence
  Synthetic oligonucleotide
ggaacctcaattaagtccag

SEQ ID NO: 2618 - DNA, 20 bp, Artificial sequence
  Synthetic oligonucleotide
caccatactatatcacactg

SEQ ID NO: 2619 - DNA, 20 bp, Artificial sequence
  Synthetic oligonucleotide
cctcagttttatatgccatg

SEQ ID NO: 2620 - DNA, 20 bp, Artificial sequence
  Synthetic oligonucleotide
ttatggcctcaaacttggag

SEQ ID NO: 2621 - DNA, 20 bp, Artificial sequence
  Synthetic oligonucleotide
tctttctagactttcatcag

SEQ ID NO: 2622 - DNA, 20 bp, Artificial sequence
  Synthetic oligonucleotide
cactttaccaatacatttta

SEQ ID NO: 2623 - DNA, 20 bp, Artificial sequence
  Synthetic oligonucleotide
ttaggattcatcgccaccaa

SEQ ID NO: 2624 - DNA, 20 bp, Artificial sequence
  Synthetic oligonucleotide
ccaatctatcacaccaatgc

SEQ ID NO: 2625 - DNA, 20 bp, Artificial sequence
  Synthetic oligonucleotide
tcccacattaaaagctgggt

SEQ ID NO: 2626 - DNA, 20 bp, Artificial sequence
  Synthetic oligonucleotide
tctgcaagtgaaattctcag

SEQ ID NO: 2627 - DNA, 20 bp, Artificial sequence
  Synthetic oligonucleotide
gtacatatcaccaaaaacaa

SEQ ID NO: 2628 - DNA, 20 bp, Artificial sequence
  Synthetic oligonucleotide
atgtcaccttcctaatctga

SEQ ID NO: 2629 - DNA, 20 bp, Artificial sequence
  Synthetic oligonucleotide
aatagcctttataacttttc

SEQ ID NO: 2630 - DNA, 20 bp, Artificial sequence
  Synthetic oligonucleotide
tgtgttagtaatcattaagt

SEQ ID NO: 2631 - DNA, 20 bp, Artificial sequence
  Synthetic oligonucleotide
ctgccaaaaaatcttcttcc

SEQ ID NO: 2632 - DNA, 20 bp, Artificial sequence
  Synthetic oligonucleotide
tgctggttctttaacccctc

SEQ ID NO: 2633 - DNA, 20 bp, Artificial sequence
  Synthetic oligonucleotide
gctgttcaatcaagcacctt

SEQ ID NO: 2634 - DNA, 20 bp, Artificial sequence
  Synthetic oligonucleotide
ctcaaaatattattgagggt

SEQ ID NO: 2635 - DNA, 20 bp, Artificial sequence
  Synthetic oligonucleotide
tctcagtgagaatatatatc

SEQ ID NO: 2636 - DNA, 20 bp, Artificial sequence
  Synthetic oligonucleotide
tcagataatctgatcattgt

SEQ ID NO: 2637 - DNA, 20 bp, Artificial sequence
  Synthetic oligonucleotide
cttagaattaaatgctgtgg

SEQ ID NO: 2638 - DNA, 20 bp, Artificial sequence
  Synthetic oligonucleotide
gtctccccccatacccccct

SEQ ID NO: 2639 - DNA, 20 bp, Artificial sequence
  Synthetic oligonucleotide
aactccaaagacaccactct

SEQ ID NO: 2640 - DNA, 20 bp, Artificial sequence
  Synthetic oligonucleotide
agccacattatacacacttc

SEQ ID NO: 2641 - DNA, 20 bp, Artificial sequence
  Synthetic oligonucleotide
tcttagagtcattaacaaca

SEQ ID NO: 2642 - DNA, 20 bp, Artificial sequence
  Synthetic oligonucleotide
tgggcttgttccatggtaca

SEQ ID NO: 2643 - DNA, 20 bp, Artificial sequence
  Synthetic oligonucleotide
tctgatacatttctagaatg

SEQ ID NO: 2644 - DNA, 20 bp, Artificial sequence
  Synthetic oligonucleotide
actcacagtttacatctcaa

SEQ ID NO: 2645 - DNA, 20 bp, Artificial sequence
  Synthetic oligonucleotide
gtagaattaaaatatacacc

SEQ ID NO: 2646 - DNA, 20 bp, Artificial sequence
  Synthetic oligonucleotide
aggtcttgaattactttcac

SEQ ID NO: 2647 - DNA, 20 bp, Artificial sequence
  Synthetic oligonucleotide
ttggaccaaccctccttctg

SEQ ID NO: 2648 - DNA, 20 bp, Artificial sequence
  Synthetic oligonucleotide
tttgcaaacctccctctccc

SEQ ID NO: 2649 - DNA, 20 bp, Artificial sequence
  Synthetic oligonucleotide
gctcaggtagccgatgacag

SEQ ID NO: 2650 - DNA, 20 bp, Artificial sequence
  Synthetic oligonucleotide
tcagttcgccattctcagag

SEQ ID NO: 2651 - DNA, 20 bp, Artificial sequence
  Synthetic oligonucleotide
agctgggttcctgatgttga

SEQ ID NO: 2652 - DNA, 20 bp, Artificial sequence
  Synthetic oligonucleotide
caaaatctaattcctcatgt

SEQ ID NO: 2653 - DNA, 20 bp, Artificial sequence
  Synthetic oligonucleotide
tagttcataattcacattca

SEQ ID NO: 2654 - DNA, 20 bp, Artificial sequence
  Synthetic oligonucleotide
ctcagagtttctaagagccc

SEQ ID NO: 2655 - DNA, 20 bp, Artificial sequence
  Synthetic oligonucleotide
agttgcagccatccaagtaa

SEQ ID NO: 2656 - DNA, 20 bp, Artificial sequence
  Synthetic oligonucleotide
agcccgtattcctcttacca

SEQ ID NO: 2657 - DNA, 20 bp, Artificial sequence
  Synthetic oligonucleotide
gggaagatcaaccaaacaag

SEQ ID NO: 2658 - DNA, 20 bp, Artificial sequence
  Synthetic oligonucleotide
ggtttcttattaatagtatt

SEQ ID NO: 2659 - DNA, 20 bp, Artificial sequence
  Synthetic oligonucleotide
acaaccctactccagagcag

SEQ ID NO: 2660 - DNA, 20 bp, Artificial sequence
  Synthetic oligonucleotide
aacagtagccatgacaacca

SEQ ID NO: 2661 - DNA, 20 bp, Artificial sequence
  Synthetic oligonucleotide
tgccagaaacacaacactgt

SEQ ID NO: 2662 - DNA, 20 bp, Artificial sequence
  Synthetic oligonucleotide
catgtaactttcaacccttc

SEQ ID NO: 2663 - DNA, 20 bp, Artificial sequence
  Synthetic oligonucleotide
ttttgtccccataatgagtc

SEQ ID NO: 2664 - DNA, 20 bp, Artificial sequence
  Synthetic oligonucleotide
acatgaaaaactgaagccgg

SEQ ID NO: 2665 - DNA, 20 bp, Artificial sequence
  Synthetic oligonucleotide
cctgggccagaaaactgaaa

SEQ ID NO: 2666 - DNA, 20 bp, Artificial sequence
  Synthetic oligonucleotide
tttcttttcaataaggtgca

SEQ ID NO: 2667 - DNA, 20 bp, Artificial sequence
  Synthetic oligonucleotide
ctagaaaacctgcaagcacc

SEQ ID NO: 2668 - DNA, 20 bp, Artificial sequence
  Synthetic oligonucleotide
gctgaatttcaaacgcagca

SEQ ID NO: 2669 - DNA, 20 bp, Artificial sequence
  Synthetic oligonucleotide
gcagtaatttaaagtatgaa

SEQ ID NO: 2670 - DNA, 20 bp, Artificial sequence
  Synthetic oligonucleotide
aacaaattttaaagctcttt

SEQ ID NO: 2671 - DNA, 20 bp, Artificial sequence
  Synthetic oligonucleotide
agcatcaaccaaattcagta

SEQ ID NO: 2672 - DNA, 20 bp, Artificial sequence
  Synthetic oligonucleotide
ccctgacctatttaacatac

SEQ ID NO: 2673 - DNA, 20 bp, Artificial sequence
  Synthetic oligonucleotide
ctgtttaaccaaaaacatct

SEQ ID NO: 2674 - DNA, 20 bp, Artificial sequence
  Synthetic oligonucleotide
atcactaaacgatagcacaa

SEQ ID NO: 2675 - DNA, 20 bp, Artificial sequence
  Synthetic oligonucleotide
aactccttttaaattgaatt

SEQ ID NO: 2676 - DNA, 20 bp, Artificial sequence
  Synthetic oligonucleotide
gggattaaataattatgtgc

SEQ ID NO: 2677 - DNA, 20 bp, Artificial sequence
  Synthetic oligonucleotide
gctagcatattttaaagaag

SEQ ID NO: 2678 - DNA, 20 bp, Artificial sequence
  Synthetic oligonucleotide
ccagcatttcaaagagcaac

SEQ ID NO: 2679 - DNA, 20 bp, Artificial sequence
  Synthetic oligonucleotide
ggcatgtttatataacagcc

SEQ ID NO: 2680 - DNA, 20 bp, Artificial sequence
  Synthetic oligonucleotide
ttcctaaaagaatttatcca

SEQ ID NO: 2681 - DNA, 20 bp, Artificial sequence
  Synthetic oligonucleotide
gtttcaatattttatgcaaa

SEQ ID NO: 2682 - DNA, 20 bp, Artificial sequence
  Synthetic oligonucleotide
gcagtaataatttagccaaa

SEQ ID NO: 2683 - DNA, 20 bp, Artificial sequence
  Synthetic oligonucleotide
gctattagacaatatagagt

SEQ ID NO: 2684 - DNA, 20 bp, Artificial sequence
  Synthetic oligonucleotide
cacttcaaacctttatcagt

SEQ ID NO: 2685 - DNA, 20 bp, Artificial sequence
  Synthetic oligonucleotide
aatcctttaatttaacaacc

SEQ ID NO: 2686 - DNA, 20 bp, Artificial sequence
  Synthetic oligonucleotide
ccatgaagaatttaacctca

SEQ ID NO: 2687 - DNA, 20 bp, Artificial sequence
  Synthetic oligonucleotide
ggaggttaattcattacaca

SEQ ID NO: 2688 - DNA, 20 bp, Artificial sequence
  Synthetic oligonucleotide
tggccttatcatacctaaat

SEQ ID NO: 2689 - DNA, 20 bp, Artificial sequence
  Synthetic oligonucleotide
attgatcaccccagcaccag

SEQ ID NO: 2690 - DNA, 20 bp, Artificial sequence
  Synthetic oligonucleotide
ttaccccaagcccagcaggt

SEQ ID NO: 2691 - DNA, 20 bp, Artificial sequence
  Synthetic oligonucleotide
cccaaaacaattcaaaccat

SEQ ID NO: 2692 - DNA, 20 bp, Artificial sequence
  Synthetic oligonucleotide
attttctttctcctagtacc

SEQ ID NO: 2693 - DNA, 20 bp, Artificial sequence
  Synthetic oligonucleotide
agaggctgccaggcctggga

SEQ ID NO: 2694 - DNA, 20 bp, Artificial sequence
  Synthetic oligonucleotide
tggaacctcaattaagtcca

SEQ ID NO: 2695 - DNA, 20 bp, Artificial sequence
  Synthetic oligonucleotide
accaccatactatatcacac

SEQ ID NO: 2696 - DNA, 20 bp, Artificial sequence
  Synthetic oligonucleotide
ccctcagttttatatgccat

SEQ ID NO: 2697 - DNA, 20 bp, Artificial sequence
  Synthetic oligonucleotide
acttatggcctcaaacttgg

SEQ ID NO: 2698 - DNA, 20 bp, Artificial sequence
  Synthetic oligonucleotide
aagttcagccttctttctag

SEQ ID NO: 2699 - DNA, 20 bp, Artificial sequence
  Synthetic oligonucleotide
agcactttaccaatacattt

SEQ ID NO: 2700 - DNA, 20 bp, Artificial sequence
  Synthetic oligonucleotide
actatctattttttgataca

SEQ ID NO: 2701 - DNA, 20 bp, Artificial sequence
  Synthetic oligonucleotide
gtaaccaatctatcacacca

SEQ ID NO: 2702 - DNA, 20 bp, Artificial sequence
  Synthetic oligonucleotide
atcccacattaaaagctggg

SEQ ID NO: 2703 - DNA, 20 bp, Artificial sequence
  Synthetic oligonucleotide
gcattcttaactttgtctgc

SEQ ID NO: 2704 - DNA, 20 bp, Artificial sequence
  Synthetic oligonucleotide
gtgctatgtctatatacaca

SEQ ID NO: 2705 - DNA, 20 bp, Artificial sequence
  Synthetic oligonucleotide
gggctcataattatttttta

SEQ ID NO: 2706 - DNA, 20 bp, Artificial sequence
  Synthetic oligonucleotide
gaatagcctttataactttt

SEQ ID NO: 2707 - DNA, 20 bp, Artificial sequence
  Synthetic oligonucleotide
tcagttattttctctccact

SEQ ID NO: 2708 - DNA, 20 bp, Artificial sequence
  Synthetic oligonucleotide
cctgccaaaaaatcttcttc

SEQ ID NO: 2709 - DNA, 20 bp, Artificial sequence
  Synthetic oligonucleotide
ttgctggttctttaacccct

SEQ ID NO: 2710 - DNA, 20 bp, Artificial sequence
  Synthetic oligonucleotide
cggctgttcaatcaagcacc

SEQ ID NO: 2711 - DNA, 20 bp, Artificial sequence
  Synthetic oligonucleotide
cctcaaaatattattgaggg

SEQ ID NO: 2712 - DNA, 20 bp, Artificial sequence
  Synthetic oligonucleotide
tgaagaaatctcactgaggg

SEQ ID NO: 2713 - DNA, 20 bp, Artificial sequence
  Synthetic oligonucleotide
agattattcagataatctga

SEQ ID NO: 2714 - DNA, 20 bp, Artificial sequence
  Synthetic oligonucleotide
ccttagaattaaatgctgtg

SEQ ID NO: 2715 - DNA, 20 bp, Artificial sequence
  Synthetic oligonucleotide
tcctcgatactaaccccttc

SEQ ID NO: 2716 - DNA, 20 bp, Artificial sequence
  Synthetic oligonucleotide
tcaaaactccaaagacacca

SEQ ID NO: 2717 - DNA, 20 bp, Artificial sequence
  Synthetic oligonucleotide
gagccacattatacacactt

SEQ ID NO: 2718 - DNA, 20 bp, Artificial sequence
  Synthetic oligonucleotide
cctcttagagtcattaacaa

SEQ ID NO: 2719 - DNA, 20 bp, Artificial sequence
  Synthetic oligonucleotide
agtaggatccaaaggcatga

SEQ ID NO: 2720 - DNA, 20 bp, Artificial sequence
  Synthetic oligonucleotide
gttctgatacatttctagaa

SEQ ID NO: 2721 - DNA, 20 bp, Artificial sequence
  Synthetic oligonucleotide
gaactcacagtttacatctc

SEQ ID NO: 2722 - DNA, 20 bp, Artificial sequence
  Synthetic oligonucleotide
tgtagaattaaaatatacac

SEQ ID NO: 2723 - DNA, 20 bp, Artificial sequence
  Synthetic oligonucleotide
tgagtccctaaaactggatt

SEQ ID NO: 2724 - DNA, 20 bp, Artificial sequence
  Synthetic oligonucleotide
tcctttctagatgtagtaga

SEQ ID NO: 2725 - DNA, 20 bp, Artificial sequence
  Synthetic oligonucleotide
gtttgcaaacctccctctcc

SEQ ID NO: 2726 - DNA, 20 bp, Artificial sequence
  Synthetic oligonucleotide
ggagcctttcatgaagtagg

SEQ ID NO: 2727 - DNA, 20 bp, Artificial sequence
  Synthetic oligonucleotide
tctggaaacttcagttcgcc

SEQ ID NO: 2728 - DNA, 20 bp, Artificial sequence
  Synthetic oligonucleotide
ttaactttccaaatctgcca

SEQ ID NO: 2729 - DNA, 20 bp, Artificial sequence
  Synthetic oligonucleotide
cttcaaaatctaattcctca

SEQ ID NO: 2730 - DNA, 20 bp, Artificial sequence
  Synthetic oligonucleotide
tactagttcataattcacat

SEQ ID NO: 2731 - DNA, 20 bp, Artificial sequence
  Synthetic oligonucleotide
tctcagagtttctaagagcc

SEQ ID NO: 2732 - DNA, 20 bp, Artificial sequence
  Synthetic oligonucleotide
atttgttcagtttagttgca

SEQ ID NO: 2733 - DNA, 20 bp, Artificial sequence
  Synthetic oligonucleotide
gagaacaaagtctatgtggc

SEQ ID NO: 2734 - DNA, 20 bp, Artificial sequence
  Synthetic oligonucleotide
ggctccttccctccagccct

SEQ ID NO: 2735 - DNA, 20 bp, Artificial sequence
  Synthetic oligonucleotide
ttggtttcttattaatagta

SEQ ID NO: 2736 - DNA, 20 bp, Artificial sequence
  Synthetic oligonucleotide
ttgtacaaccctactccaga

SEQ ID NO: 2737 - DNA, 20 bp, Artificial sequence
  Synthetic oligonucleotide
ggttcatgaaacagtagcca

SEQ ID NO: 2738 - DNA, 20 bp, Artificial sequence
  Synthetic oligonucleotide
tatgccagaaacacaacact

SEQ ID NO: 2739 - DNA, 20 bp, Artificial sequence
  Synthetic oligonucleotide
acatgtaactttcaaccctt

SEQ ID NO: 2740 - DNA, 20 bp, Artificial sequence
  Synthetic oligonucleotide
tttttgtccccataatgagt

SEQ ID NO: 2741 - DNA, 20 bp, Artificial sequence
  Synthetic oligonucleotide
gggacatgaaaaactgaagc

SEQ ID NO: 2742 - DNA, 20 bp, Artificial sequence
  Synthetic oligonucleotide
aggatttaccccactcctgg

SEQ ID NO: 2743 - DNA, 20 bp, Artificial sequence
  Synthetic oligonucleotide
attttcttttcaataaggtg

SEQ ID NO: 2744 - DNA, 20 bp, Artificial sequence
  Synthetic oligonucleotide
tctacctagaaaacctgcaa

SEQ ID NO: 2745 - DNA, 20 bp, Artificial sequence
  Synthetic oligonucleotide
ctcacattttaaagagtctg

SEQ ID NO: 2746 - DNA, 20 bp, Artificial sequence
  Synthetic oligonucleotide
tcactgaacccttatttttt

SEQ ID NO: 2747 - DNA, 20 bp, Artificial sequence
  Synthetic oligonucleotide
actagaaaagccacccttct

SEQ ID NO: 2748 - DNA, 20 bp, Artificial sequence
  Synthetic oligonucleotide
agtctgtatatttatattta

SEQ ID NO: 2749 - DNA, 20 bp, Artificial sequence
  Synthetic oligonucleotide
cctttgttttaaaataggta

SEQ ID NO: 2750 - DNA, 20 bp, Artificial sequence
  Synthetic oligonucleotide
aatgccaaagatatacgcca

SEQ ID NO: 2751 - DNA, 20 bp, Artificial sequence
  Synthetic oligonucleotide
agttaatatccttaatacaa

SEQ ID NO: 2752 - DNA, 20 bp, Artificial sequence
  Synthetic oligonucleotide
aagtactatcattattgcat

SEQ ID NO: 2753 - DNA, 20 bp, Artificial sequence
  Synthetic oligonucleotide
ttccccttattttattcata

SEQ ID NO: 2754 - DNA, 20 bp, Artificial sequence
  Synthetic oligonucleotide
ttccttctagattaaagact

SEQ ID NO: 2755 - DNA, 20 bp, Artificial sequence
  Synthetic oligonucleotide
aacacaatttaaattgagtt

SEQ ID NO: 2756 - DNA, 20 bp, Artificial sequence
  Synthetic oligonucleotide
cctaagtacccttaattttt

SEQ ID NO: 2757 - DNA, 20 bp, Artificial sequence
  Synthetic oligonucleotide
tgtctatttcaaagaagcga

SEQ ID NO: 2758 - DNA, 20 bp, Artificial sequence
  Synthetic oligonucleotide
cacacaattcaaaacttgaa

SEQ ID NO: 2759 - DNA, 20 bp, Artificial sequence
  Synthetic oligonucleotide
agcagaatctaaatcgaaca

SEQ ID NO: 2760 - DNA, 20 bp, Artificial sequence
  Synthetic oligonucleotide
cgtgtttttatttaacaata

SEQ ID NO: 2761 - DNA, 20 bp, Artificial sequence
  Synthetic oligonucleotide
atttcttatatttatgggct

SEQ ID NO: 2762 - DNA, 20 bp, Artificial sequence
  Synthetic oligonucleotide
tatagtagtatttatagctc

SEQ ID NO: 2763 - DNA, 20 bp, Artificial sequence
  Synthetic oligonucleotide
accccatttcaaagacaagg

SEQ ID NO: 2764 - DNA, 20 bp, Artificial sequence
  Synthetic oligonucleotide
tggaggttaattcattacac

SEQ ID NO: 2765 - DNA, 20 bp, Artificial sequence
  Synthetic oligonucleotide
ttggccttatcatacctaaa

SEQ ID NO: 2766 - DNA, 20 bp, Artificial sequence
  Synthetic oligonucleotide
gtgcccagcccttccacctg

SEQ ID NO: 2767 - DNA, 20 bp, Artificial sequence
  Synthetic oligonucleotide
gactttaccccaagcccagc

SEQ ID NO: 2768 - DNA, 20 bp, Artificial sequence
  Synthetic oligonucleotide
tgcccaaaacaattcaaacc

SEQ ID NO: 2769 - DNA, 20 bp, Artificial sequence
  Synthetic oligonucleotide
agttcattttctttctccta

SEQ ID NO: 2770 - DNA, 20 bp, Artificial sequence
  Synthetic oligonucleotide
gtctggtttctgcagaggct

SEQ ID NO: 2771 - DNA, 20 bp, Artificial sequence
  Synthetic oligonucleotide
cctttggaacctcaattaag

SEQ ID NO: 2772 - DNA, 20 bp, Artificial sequence
  Synthetic oligonucleotide
tgtcaccaccatactatatc

SEQ ID NO: 2773 - DNA, 20 bp, Artificial sequence
  Synthetic oligonucleotide
cccctcagttttatatgcca

SEQ ID NO: 2774 - DNA, 20 bp, Artificial sequence
  Synthetic oligonucleotide
gcgccacagacttatggcct

SEQ ID NO: 2775 - DNA, 20 bp, Artificial sequence
  Synthetic oligonucleotide
ggcagggtaaaaatggctta

SEQ ID NO: 2776 - DNA, 20 bp, Artificial sequence
  Synthetic oligonucleotide
gagcactttaccaatacatt

SEQ ID NO: 2777 - DNA, 20 bp, Artificial sequence
  Synthetic oligonucleotide
accaactatctattttttga

SEQ ID NO: 2778 - DNA, 20 bp, Artificial sequence
  Synthetic oligonucleotide
tgtaaccaatctatcacacc

SEQ ID NO: 2779 - DNA, 20 bp, Artificial sequence
  Synthetic oligonucleotide
acacaaatcccacattaaaa

SEQ ID NO: 2780 - DNA, 20 bp, Artificial sequence
  Synthetic oligonucleotide
tgggcattcttaactttgtc

SEQ ID NO: 2781 - DNA, 20 bp, Artificial sequence
  Synthetic oligonucleotide
ttgtatatttcaatcttaga

SEQ ID NO: 2782 - DNA, 20 bp, Artificial sequence
  Synthetic oligonucleotide
ttctgggctcataattattt

SEQ ID NO: 2783 - DNA, 20 bp, Artificial sequence
  Synthetic oligonucleotide
tagaatagcctttataactt

SEQ ID NO: 2784 - DNA, 20 bp, Artificial sequence
  Synthetic oligonucleotide
ttcagttattttctctccac

SEQ ID NO: 2785 - DNA, 20 bp, Artificial sequence
  Synthetic oligonucleotide
tcctgccaaaaaatcttctt

SEQ ID NO: 2786 - DNA, 20 bp, Artificial sequence
  Synthetic oligonucleotide
actccctacactgtagcaac

SEQ ID NO: 2787 - DNA, 20 bp, Artificial sequence
  Synthetic oligonucleotide
aatggtatcccattcttccg

SEQ ID NO: 2788 - DNA, 20 bp, Artificial sequence
  Synthetic oligonucleotide
ggcctcaaaatattattgag

SEQ ID NO: 2789 - DNA, 20 bp, Artificial sequence
  Synthetic oligonucleotide
ttaactgatcattaaccgtt

SEQ ID NO: 2790 - DNA, 20 bp, Artificial sequence
  Synthetic oligonucleotide
aagattattcagataatctg

SEQ ID NO: 2791 - DNA, 20 bp, Artificial sequence
  Synthetic oligonucleotide
ggccttagaattaaatgctg

SEQ ID NO: 2792 - DNA, 20 bp, Artificial sequence
  Synthetic oligonucleotide
ctcctcgatactaacccctt

SEQ ID NO: 2793 - DNA, 20 bp, Artificial sequence
  Synthetic oligonucleotide
tctcaaaactccaaagacac

SEQ ID NO: 2794 - DNA, 20 bp, Artificial sequence
  Synthetic oligonucleotide
gtgagccacattatacacac

SEQ ID NO: 2795 - DNA, 20 bp, Artificial sequence
  Synthetic oligonucleotide
tcttgcaaacctcttagagt

SEQ ID NO: 2796 - DNA, 20 bp, Artificial sequence
  Synthetic oligonucleotide
attgactgaaataagtagga

SEQ ID NO: 2797 - DNA, 20 bp, Artificial sequence
  Synthetic oligonucleotide
tagttctgatacatttctag

SEQ ID NO: 2798 - DNA, 20 bp, Artificial sequence
  Synthetic oligonucleotide
catattatctccaaataagc

SEQ ID NO: 2799 - DNA, 20 bp, Artificial sequence
  Synthetic oligonucleotide
ggtctatgagaattgtagaa

SEQ ID NO: 2800 - DNA, 20 bp, Artificial sequence
  Synthetic oligonucleotide
ctgagtccctaaaactggat

SEQ ID NO: 2801 - DNA, 20 bp, Artificial sequence
  Synthetic oligonucleotide
agtcaatttccaatgtcctt

SEQ ID NO: 2802 - DNA, 20 bp, Artificial sequence
  Synthetic oligonucleotide
agtttgcaaacctccctctc

SEQ ID NO: 2803 - DNA, 20 bp, Artificial sequence
  Synthetic oligonucleotide
tggagcctttcatgaagtag

SEQ ID NO: 2804 - DNA, 20 bp, Artificial sequence
  Synthetic oligonucleotide
ctctggaaacttcagttcgc

SEQ ID NO: 2805 - DNA, 20 bp, Artificial sequence
  Synthetic oligonucleotide
gttaactttccaaatctgcc

SEQ ID NO: 2806 - DNA, 20 bp, Artificial sequence
  Synthetic oligonucleotide
atcttcaaaatctaattcct

SEQ ID NO: 2807 - DNA, 20 bp, Artificial sequence
  Synthetic oligonucleotide
atactagttcataattcaca

SEQ ID NO: 2808 - DNA, 20 bp, Artificial sequence
  Synthetic oligonucleotide
aagaaaattctcagagtttc

SEQ ID NO: 2809 - DNA, 20 bp, Artificial sequence
  Synthetic oligonucleotide
agtcaggtatttgttcagtt

SEQ ID NO: 2810 - DNA, 20 bp, Artificial sequence
  Synthetic oligonucleotide
gtaaatagtgatattaatga

SEQ ID NO: 2811 - DNA, 20 bp, Artificial sequence
  Synthetic oligonucleotide
gctccccgccccagcactca

SEQ ID NO: 2812 - DNA, 20 bp, Artificial sequence
  Synthetic oligonucleotide
ttgttggtttcttattaata

SEQ ID NO: 2813 - DNA, 20 bp, Artificial sequence
  Synthetic oligonucleotide
attgtacaaccctactccag

SEQ ID NO: 2814 - DNA, 20 bp, Artificial sequence
  Synthetic oligonucleotide
gtggttcatgaaacagtagc

SEQ ID NO: 2815 - DNA, 20 bp, Artificial sequence
  Synthetic oligonucleotide
cctatgccagaaacacaaca

SEQ ID NO: 2816 - DNA, 20 bp, Artificial sequence
  Synthetic oligonucleotide
ctatatacaaaaaaacatgt

SEQ ID NO: 2817 - DNA, 20 bp, Artificial sequence
  Synthetic oligonucleotide
cccccatttaaatgaggtgt

SEQ ID NO: 2818 - DNA, 20 bp, Artificial sequence
  Synthetic oligonucleotide
cagttgaaccatttgtatgc

SEQ ID NO: 2819 - DNA, 20 bp, Artificial sequence
  Synthetic oligonucleotide
tgcactaactaaaggattta

SEQ ID NO: 2820 - DNA, 20 bp, Artificial sequence
  Synthetic oligonucleotide
aattttcttttcaataaggt

SEQ ID NO: 2821 - DNA, 20 bp, Artificial sequence
  Synthetic oligonucleotide
ttctacctagaaaacctgca

SEQ ID NO: 2822 - DNA, 20 bp, Artificial sequence
  Synthetic oligonucleotide
ctcgaaaaacatatccccca

SEQ ID NO: 2823 - DNA, 20 bp, Artificial sequence
  Synthetic oligonucleotide
tggtaattttaaaatatggg

SEQ ID NO: 2824 - DNA, 20 bp, Artificial sequence
  Synthetic oligonucleotide
gtgttaattcaaaaaatttc

SEQ ID NO: 2825 - DNA, 20 bp, Artificial sequence
  Synthetic oligonucleotide
tgcatacaaatttagtctgt

SEQ ID NO: 2826 - DNA, 20 bp, Artificial sequence
  Synthetic oligonucleotide
tctagattacaaaccatcct

SEQ ID NO: 2827 - DNA, 20 bp, Artificial sequence
  Synthetic oligonucleotide
tttcattttatttaagccaa

SEQ ID NO: 2828 - DNA, 20 bp, Artificial sequence
  Synthetic oligonucleotide
aagatgttttaaaatctgac

SEQ ID NO: 2829 - DNA, 20 bp, Artificial sequence
  Synthetic oligonucleotide
gtacttgttccttaaccaag

SEQ ID NO: 2830 - DNA, 20 bp, Artificial sequence
  Synthetic oligonucleotide
tcagtttacctttaatggaa

SEQ ID NO: 2831 - DNA, 20 bp, Artificial sequence
  Synthetic oligonucleotide
tgctcaatattttaaacatt

SEQ ID NO: 2832 - DNA, 20 bp, Artificial sequence
  Synthetic oligonucleotide
gtcggataaatttatccaca

SEQ ID NO: 2833 - DNA, 20 bp, Artificial sequence
  Synthetic oligonucleotide
ttagcaaacatttatgagca

SEQ ID NO: 2834 - DNA, 20 bp, Artificial sequence
  Synthetic oligonucleotide
cttccaatccattacatctt

SEQ ID NO: 2835 - DNA, 20 bp, Artificial sequence
  Synthetic oligonucleotide
ccttccaacccttagccttt

SEQ ID NO: 2836 - DNA, 20 bp, Artificial sequence
  Synthetic oligonucleotide
agccaaaaacccatggacca

SEQ ID NO: 2837 - DNA, 20 bp, Artificial sequence
  Synthetic oligonucleotide
acagtaatcttttatacaag

SEQ ID NO: 2838 - DNA, 20 bp, Artificial sequence
  Synthetic oligonucleotide
ttcccgaacccttaaggata

SEQ ID NO: 2839 - DNA, 20 bp, Artificial sequence
  Synthetic oligonucleotide
agttgacacctttatagtag

SEQ ID NO: 2840 - DNA, 20 bp, Artificial sequence
  Synthetic oligonucleotide
gtcttaaaactattcactgt

SEQ ID NO: 2841 - DNA, 20 bp, Artificial sequence
  Synthetic oligonucleotide
ataactagccccactctcca

SEQ ID NO: 2842 - DNA, 20 bp, Artificial sequence
  Synthetic oligonucleotide
gttggccttatcatacctaa

SEQ ID NO: 2843 - DNA, 20 bp, Artificial sequence
  Synthetic oligonucleotide
gctgccttccatctgttttt

SEQ ID NO: 2844 - DNA, 20 bp, Artificial sequence
  Synthetic oligonucleotide
tgactttaccccaagcccag

SEQ ID NO: 2845 - DNA, 20 bp, Artificial sequence
  Synthetic oligonucleotide
gagacaagaaacactgtctc

SEQ ID NO: 2846 - DNA, 20 bp, Artificial sequence
  Synthetic oligonucleotide
ctcaaggtagttcattttct

SEQ ID NO: 2847 - DNA, 20 bp, Artificial sequence
  Synthetic oligonucleotide
gcctacaatcccagctttag

SEQ ID NO: 2848 - DNA, 20 bp, Artificial sequence
  Synthetic oligonucleotide
gagaaaacccctcaggaagg

SEQ ID NO: 2849 - DNA, 20 bp, Artificial sequence
  Synthetic oligonucleotide
tctgtcaccaccatactata

SEQ ID NO: 2850 - DNA, 20 bp, Artificial sequence
  Synthetic oligonucleotide
ctaaacacccctcagtttta

SEQ ID NO: 2851 - DNA, 20 bp, Artificial sequence
  Synthetic oligonucleotide
tggatgcgccacagacttat

SEQ ID NO: 2852 - DNA, 20 bp, Artificial sequence
  Synthetic oligonucleotide
aggcagggtaaaaatggctt

SEQ ID NO: 2853 - DNA, 20 bp, Artificial sequence
  Synthetic oligonucleotide
ccagagcactttaccaatac

SEQ ID NO: 2854 - DNA, 20 bp, Artificial sequence
  Synthetic oligonucleotide
caccaactatctattttttg

SEQ ID NO: 2855 - DNA, 20 bp, Artificial sequence
  Synthetic oligonucleotide
cagttgtaaccaatctatca

SEQ ID NO: 2856 - DNA, 20 bp, Artificial sequence
  Synthetic oligonucleotide
ctcctaacacaaatcccaca

SEQ ID NO: 2857 - DNA, 20 bp, Artificial sequence
  Synthetic oligonucleotide
cgaaattattaaattgggca

SEQ ID NO: 2858 - DNA, 20 bp, Artificial sequence
  Synthetic oligonucleotide
gattgtatatttcaatctta

SEQ ID NO: 2859 - DNA, 20 bp, Artificial sequence
  Synthetic oligonucleotide
acaacaccgactcacttctg

SEQ ID NO: 2860 - DNA, 20 bp, Artificial sequence
  Synthetic oligonucleotide
tcaaacaccctaagcagtaa

SEQ ID NO: 2861 - DNA, 20 bp, Artificial sequence
  Synthetic oligonucleotide
cttcagttattttctctcca

SEQ ID NO: 2862 - DNA, 20 bp, Artificial sequence
  Synthetic oligonucleotide
atcctgccaaaaaatcttct

SEQ ID NO: 2863 - DNA, 20 bp, Artificial sequence
  Synthetic oligonucleotide
ccttactccctacactgtag

SEQ ID NO: 2864 - DNA, 20 bp, Artificial sequence
  Synthetic oligonucleotide
atgttcttccccatctccat

SEQ ID NO: 2865 - DNA, 20 bp, Artificial sequence
  Synthetic oligonucleotide
cggcctcaaaatattattga

SEQ ID NO: 2866 - DNA, 20 bp, Artificial sequence
  Synthetic oligonucleotide
gatataaacattcttaaagg

SEQ ID NO: 2867 - DNA, 20 bp, Artificial sequence
  Synthetic oligonucleotide
ggaagattattcagataatc

SEQ ID NO: 2868 - DNA, 20 bp, Artificial sequence
  Synthetic oligonucleotide
aggccttagaattaaatgct

SEQ ID NO: 2869 - DNA, 20 bp, Artificial sequence
  Synthetic oligonucleotide
cagtctcctcgatactaacc

SEQ ID NO: 2870 - DNA, 20 bp, Artificial sequence
  Synthetic oligonucleotide
atctcaaaactccaaagaca

SEQ ID NO: 2871 - DNA, 20 bp, Artificial sequence
  Synthetic oligonucleotide
tgtgagccacattatacaca

SEQ ID NO: 2872 - DNA, 20 bp, Artificial sequence
  Synthetic oligonucleotide
ctcttgcaaacctcttagag

SEQ ID NO: 2873 - DNA, 20 bp, Artificial sequence
  Synthetic oligonucleotide
tcctgctaccccccaacagt

SEQ ID NO: 2874 - DNA, 20 bp, Artificial sequence
  Synthetic oligonucleotide
ttcatcttctttgtttcctt

SEQ ID NO: 2875 - DNA, 20 bp, Artificial sequence
  Synthetic oligonucleotide
aacaaaatacatattatctc

SEQ ID NO: 2876 - DNA, 20 bp, Artificial sequence
  Synthetic oligonucleotide
ccgtttctacagaaatttaa

SEQ ID NO: 2877 - DNA, 20 bp, Artificial sequence
  Synthetic oligonucleotide
tctgagtccctaaaactgga

SEQ ID NO: 2878 - DNA, 20 bp, Artificial sequence
  Synthetic oligonucleotide
cccagcccctaaaaggatgc

SEQ ID NO: 2879 - DNA, 20 bp, Artificial sequence
  Synthetic oligonucleotide
aggtatgaactcacacagac

SEQ ID NO: 2880 - DNA, 20 bp, Artificial sequence
  Synthetic oligonucleotide
ttccaccttctttagctccc

SEQ ID NO: 2881 - DNA, 20 bp, Artificial sequence
  Synthetic oligonucleotide
caggcaatcccattttctct

SEQ ID NO: 2882 - DNA, 20 bp, Artificial sequence
  Synthetic oligonucleotide
atgttcttttaaatggttaa

SEQ ID NO: 2883 - DNA, 20 bp, Artificial sequence
  Synthetic oligonucleotide
catcttcaaaatctaattcc

SEQ ID NO: 2884 - DNA, 20 bp, Artificial sequence
  Synthetic oligonucleotide
cacatactagttcataattc

SEQ ID NO: 2885 - DNA, 20 bp, Artificial sequence
  Synthetic oligonucleotide
tctctcaatgaatctgaaga

SEQ ID NO: 2886 - DNA, 20 bp, Artificial sequence
  Synthetic oligonucleotide
gggtaaaagaaaagtcaggt

SEQ ID NO: 2887 - DNA, 20 bp, Artificial sequence
  Synthetic oligonucleotide
ttgtaaatagtgatattaat

SEQ ID NO: 2888 - DNA, 20 bp, Artificial sequence
  Synthetic oligonucleotide
ctgcggttcctcccccgggt

SEQ ID NO: 2889 - DNA, 20 bp, Artificial sequence
  Synthetic oligonucleotide
atatatttagaaatccctag

SEQ ID NO: 2890 - DNA, 20 bp, Artificial sequence
  Synthetic oligonucleotide
aattgtacaaccctactcca

SEQ ID NO: 2891 - DNA, 20 bp, Artificial sequence
  Synthetic oligonucleotide
gcaacagaccagtctgttga

SEQ ID NO: 2892 - DNA, 20 bp, Artificial sequence
  Synthetic oligonucleotide
tccctatgccagaaacacaa

SEQ ID NO: 2893 - DNA, 20 bp, Artificial sequence
  Synthetic oligonucleotide
tctatatacaaaaaaacatg

SEQ ID NO: 2894 - DNA, 20 bp, Artificial sequence
  Synthetic oligonucleotide
ccccccatttaaatgaggtg

SEQ ID NO: 2895 - DNA, 20 bp, Artificial sequence
  Synthetic oligonucleotide
tacagttgaaccatttgtat

SEQ ID NO: 2896 - DNA, 20 bp, Artificial sequence
  Synthetic oligonucleotide
gcacaggtatcaagttcaaa

SEQ ID NO: 2897 - DNA, 20 bp, Artificial sequence
  Synthetic oligonucleotide
acttaaaattttcttttcaa

SEQ ID NO: 2898 - DNA, 20 bp, Artificial sequence
  Synthetic oligonucleotide
aatgaaataatttctaccta

SEQ ID NO: 2899 - DNA, 20 bp, Artificial sequence
  Synthetic oligonucleotide
ggcacattttaaaaagaagc

SEQ ID NO: 2900 - DNA, 20 bp, Artificial sequence
  Synthetic oligonucleotide
tgtttgctattttaagagcc

SEQ ID NO: 2901 - DNA, 20 bp, Artificial sequence
  Synthetic oligonucleotide
gctagtaaaatttagggcag

SEQ ID NO: 2902 - DNA, 20 bp, Artificial sequence
  Synthetic oligonucleotide
tctgaaaaacctcttcctct

SEQ ID NO: 2903 - DNA, 20 bp, Artificial sequence
  Synthetic oligonucleotide
gatgcatttcattactgctt

SEQ ID NO: 2904 - DNA, 20 bp, Artificial sequence
  Synthetic oligonucleotide
atgtaatattaaatagcatc

SEQ ID NO: 2905 - DNA, 20 bp, Artificial sequence
  Synthetic oligonucleotide
aggtaatttcaaagcttcca

SEQ ID NO: 2906 - DNA, 20 bp, Artificial sequence
  Synthetic oligonucleotide
ctttcaattccttaaaagga

SEQ ID NO: 2907 - DNA, 20 bp, Artificial sequence
  Synthetic oligonucleotide
acacacaaagaatgaaccat

SEQ ID NO: 2908 - DNA, 20 bp, Artificial sequence
  Synthetic oligonucleotide
atcctaattcaaaaactagt

SEQ ID NO: 2909 - DNA, 20 bp, Artificial sequence
  Synthetic oligonucleotide
agccataaaaccatgcggtt

SEQ ID NO: 2910 - DNA, 20 bp, Artificial sequence
  Synthetic oligonucleotide
ttacccaaattatcactgta

SEQ ID NO: 2911 - DNA, 20 bp, Artificial sequence
  Synthetic oligonucleotide
ggacttaacccttactccaa

SEQ ID NO: 2912 - DNA, 20 bp, Artificial sequence
  Synthetic oligonucleotide
tgttagctattttatatgga

SEQ ID NO: 2913 - DNA, 20 bp, Artificial sequence
  Synthetic oligonucleotide
ttacacagccaaaaacccat

SEQ ID NO: 2914 - DNA, 20 bp, Artificial sequence
  Synthetic oligonucleotide
tgagtaatttaaaatgccca

SEQ ID NO: 2915 - DNA, 20 bp, Artificial sequence
  Synthetic oligonucleotide
aaggtctgcctttaacattt

SEQ ID NO: 2916 - DNA, 20 bp, Artificial sequence
  Synthetic oligonucleotide
gtaaaatttctttatgtgtg

SEQ ID NO: 2917 - DNA, 20 bp, Artificial sequence
  Synthetic oligonucleotide
agtcttaaaactattcactg

SEQ ID NO: 2918 - DNA, 20 bp, Artificial sequence
  Synthetic oligonucleotide
tcaaggactccataactagc

SEQ ID NO: 2919 - DNA, 20 bp, Artificial sequence
  Synthetic oligonucleotide
gctgatctatctgttggcct

SEQ ID NO: 2920 - DNA, 20 bp, Artificial sequence
  Synthetic oligonucleotide
tagggctgccttccatctgt

SEQ ID NO: 2921 - DNA, 20 bp, Artificial sequence
  Synthetic oligonucleotide
gctgactttaccccaagccc

SEQ ID NO: 2922 - DNA, 20 bp, Artificial sequence
  Synthetic oligonucleotide
aatgctcaaaaaagccagac

SEQ ID NO: 2923 - DNA, 20 bp, Artificial sequence
  Synthetic oligonucleotide
ctgtgaagagtcaactttgc

SEQ ID NO: 2924 - DNA, 20 bp, Artificial sequence
  Synthetic oligonucleotide
cgcctacaatcccagcttta

SEQ ID NO: 2925 - DNA, 20 bp, Artificial sequence
  Synthetic oligonucleotide
ggaagattcttcaggctagg

SEQ ID NO: 2926 - DNA, 20 bp, Artificial sequence
  Synthetic oligonucleotide
gtctgtcaccaccatactat

SEQ ID NO: 2927 - DNA, 20 bp, Artificial sequence
  Synthetic oligonucleotide
cccaaactaaacacccctca

SEQ ID NO: 2928 - DNA, 20 bp, Artificial sequence
  Synthetic oligonucleotide
agccccatccttcttttgag

SEQ ID NO: 2929 - DNA, 20 bp, Artificial sequence
  Synthetic oligonucleotide
cgaggattacaggcagggta

SEQ ID NO: 2930 - DNA, 20 bp, Artificial sequence
  Synthetic oligonucleotide
cgtgtcaacccagagcactt

SEQ ID NO: 2931 - DNA, 20 bp, Artificial sequence
  Synthetic oligonucleotide
agtcaccaactatctatttt

SEQ ID NO: 2932 - DNA, 20 bp, Artificial sequence
  Synthetic oligonucleotide
tcagttgtaaccaatctatc

SEQ ID NO: 2933 - DNA, 20 bp, Artificial sequence
  Synthetic oligonucleotide
gcctcctaacacaaatccca

SEQ ID NO: 2934 - DNA, 20 bp, Artificial sequence
  Synthetic oligonucleotide
gcgaaattattaaattgggc

SEQ ID NO: 2935 - DNA, 20 bp, Artificial sequence
  Synthetic oligonucleotide
tgattgtatatttcaatctt

SEQ ID NO: 2936 - DNA, 20 bp, Artificial sequence
  Synthetic oligonucleotide
ggagacaacaccgactcact

SEQ ID NO: 2937 - DNA, 20 bp, Artificial sequence
  Synthetic oligonucleotide
tttcaaacaccctaagcagt

SEQ ID NO: 2938 - DNA, 20 bp, Artificial sequence
  Synthetic oligonucleotide
gaatcacacttcagttattt

SEQ ID NO: 2939 - DNA, 20 bp, Artificial sequence
  Synthetic oligonucleotide
ccatcctgccaaaaaatctt

SEQ ID NO: 2940 - DNA, 20 bp, Artificial sequence
  Synthetic oligonucleotide
ccccttactccctacactgt

SEQ ID NO: 2941 - DNA, 20 bp, Artificial sequence
  Synthetic oligonucleotide
cccatgttcttccccatctc

SEQ ID NO: 2942 - DNA, 20 bp, Artificial sequence
  Synthetic oligonucleotide
ccggcctcaaaatattattg

SEQ ID NO: 2943 - DNA, 20 bp, Artificial sequence
  Synthetic oligonucleotide
aaggatataaacattcttaa

SEQ ID NO: 2944 - DNA, 20 bp, Artificial sequence
  Synthetic oligonucleotide
agcggaagattattcagata

SEQ ID NO: 2945 - DNA, 20 bp, Artificial sequence
  Synthetic oligonucleotide
ccaaatctccaaagacaggc

SEQ ID NO: 2946 - DNA, 20 bp, Artificial sequence
  Synthetic oligonucleotide
actggtgcccaaatgtctat

SEQ ID NO: 2947 - DNA, 20 bp, Artificial sequence
  Synthetic oligonucleotide
gcatctcaaaactccaaaga

SEQ ID NO: 2948 - DNA, 20 bp, Artificial sequence
  Synthetic oligonucleotide
tgtgtgagccacattataca

SEQ ID NO: 2949 - DNA, 20 bp, Artificial sequence
  Synthetic oligonucleotide
ctccatagatcctcttgcaa

SEQ ID NO: 2950 - DNA, 20 bp, Artificial sequence
  Synthetic oligonucleotide
aagagatgaactaagcattc

SEQ ID NO: 2951 - DNA, 20 bp, Artificial sequence
  Synthetic oligonucleotide
gttgcttttctacttcatct

SEQ ID NO: 2952 - DNA, 20 bp, Artificial sequence
  Synthetic oligonucleotide
tctagaacaaaatacatatt

SEQ ID NO: 2953 - DNA, 20 bp, Artificial sequence
  Synthetic oligonucleotide
atccatgaagccaggcatgg

SEQ ID NO: 2954 - DNA, 20 bp, Artificial sequence
  Synthetic oligonucleotide
catctgagtccctaaaactg

SEQ ID NO: 2955 - DNA, 20 bp, Artificial sequence
  Synthetic oligonucleotide
gtccccagcccctaaaagga

SEQ ID NO: 2956 - DNA, 20 bp, Artificial sequence
  Synthetic oligonucleotide
caggtatgaactcacacaga

SEQ ID NO: 2957 - DNA, 20 bp, Artificial sequence
  Synthetic oligonucleotide
cttctgtttttaagtcttcc

SEQ ID NO: 2958 - DNA, 20 bp, Artificial sequence
  Synthetic oligonucleotide
gcaggcaatcccattttctc

SEQ ID NO: 2959 - DNA, 20 bp, Artificial sequence
  Synthetic oligonucleotide
ggagagaaaaatgttctttt

SEQ ID NO: 2960 - DNA, 20 bp, Artificial sequence
  Synthetic oligonucleotide
gctcatcttcaaaatctaat

SEQ ID NO: 2961 - DNA, 20 bp, Artificial sequence
  Synthetic oligonucleotide
atttattgtcacatactagt

SEQ ID NO: 2962 - DNA, 20 bp, Artificial sequence
  Synthetic oligonucleotide
cacatatataaatgtcttta

SEQ ID NO: 2963 - DNA, 20 bp, Artificial sequence
  Synthetic oligonucleotide
gaaagtactattttcaatgg

SEQ ID NO: 2964 - DNA, 20 bp, Artificial sequence
  Synthetic oligonucleotide
atgagttgtaaatagtgata

SEQ ID NO: 2965 - DNA, 20 bp, Artificial sequence
  Synthetic oligonucleotide
actgcggttcctcccccggg

SEQ ID NO: 2966 - DNA, 20 bp, Artificial sequence
  Synthetic oligonucleotide
agtcattttatatatttaga

SEQ ID NO: 2967 - DNA, 20 bp, Artificial sequence
  Synthetic oligonucleotide
gaaatccaaacattccttga

SEQ ID NO: 2968 - DNA, 20 bp, Artificial sequence
  Synthetic oligonucleotide
gccctgttttcacctggtgc

SEQ ID NO: 2969 - DNA, 20 bp, Artificial sequence
  Synthetic oligonucleotide
tttccctatgccagaaacac

SEQ ID NO: 2970 - DNA, 20 bp, Artificial sequence
  Synthetic oligonucleotide
ttctatatacaaaaaaacat

SEQ ID NO: 2971 - DNA, 20 bp, Artificial sequence
  Synthetic oligonucleotide
tccccccatttaaatgaggt

SEQ ID NO: 2972 - DNA, 20 bp, Artificial sequence
  Synthetic oligonucleotide
cacttaattttaatacagtt

SEQ ID NO: 2973 - DNA, 20 bp, Artificial sequence
  Synthetic oligonucleotide
gcagtattcacagaactgaa

SEQ ID NO: 2974 - DNA, 20 bp, Artificial sequence
  Synthetic oligonucleotide
gcacttaaaattttcttttc

SEQ ID NO: 2975 - DNA, 20 bp, Artificial sequence
  Synthetic oligonucleotide
tgttttattataataatgaa

SEQ ID NO: 2976 - DNA, 20 bp, Artificial sequence
  Synthetic oligonucleotide
acatcaaaacgatttctact

SEQ ID NO: 2977 - DNA, 20 bp, Artificial sequence
  Synthetic oligonucleotide
aaccaaaaccaaaagcctct

SEQ ID NO: 2978 - DNA, 20 bp, Artificial sequence
  Synthetic oligonucleotide
aatctaaaatacatctgcat

SEQ ID NO: 2979 - DNA, 20 bp, Artificial sequence
  Synthetic oligonucleotide
cagtttatttaaagatataa

SEQ ID NO: 2980 - DNA, 20 bp, Artificial sequence
  Synthetic oligonucleotide
atcagtaaagaattgatgtc

SEQ ID NO: 2981 - DNA, 20 bp, Artificial sequence
  Synthetic oligonucleotide
cttcataaaattccattctg

SEQ ID NO: 2982 - DNA, 20 bp, Artificial sequence
  Synthetic oligonucleotide
gctttcataatataacaacc

SEQ ID NO: 2983 - DNA, 20 bp, Artificial sequence
  Synthetic oligonucleotide
atcaacaaaattatgtatgg

SEQ ID NO: 2984 - DNA, 20 bp, Artificial sequence
  Synthetic oligonucleotide
ggaaacaaccaaagtttttt

SEQ ID NO: 2985 - DNA, 20 bp, Artificial sequence
  Synthetic oligonucleotide
ctgtagttttaaaagtgcct

SEQ ID NO: 2986 - DNA, 20 bp, Artificial sequence
  Synthetic oligonucleotide
accatatttctttagaaggt

SEQ ID NO: 2987 - DNA, 20 bp, Artificial sequence
  Synthetic oligonucleotide
gtgaccaaaatacatatact

SEQ ID NO: 2988 - DNA, 20 bp, Artificial sequence
  Synthetic oligonucleotide
actggatttatttaagtctt

SEQ ID NO: 2989 - DNA, 20 bp, Artificial sequence
  Synthetic oligonucleotide
gagtcttgcccttaagaagc

SEQ ID NO: 2990 - DNA, 20 bp, Artificial sequence
  Synthetic oligonucleotide
ttgatatttcaaaagagcta

SEQ ID NO: 2991 - DNA, 20 bp, Artificial sequence
  Synthetic oligonucleotide
atgtaaatattttagcacag

SEQ ID NO: 2992 - DNA, 20 bp, Artificial sequence
  Synthetic oligonucleotide
gactaattttaaaatatgct

SEQ ID NO: 2993 - DNA, 20 bp, Artificial sequence
  Synthetic oligonucleotide
gagataaaaattatgtagtt

SEQ ID NO: 2994 - DNA, 20 bp, Artificial sequence
  Synthetic oligonucleotide
tgggataatatttataagtg

SEQ ID NO: 2995 - DNA, 20 bp, Artificial sequence
  Synthetic oligonucleotide
atcttaatcacagaattcaa

SEQ ID NO: 2996 - DNA, 20 bp, Artificial sequence
  Synthetic oligonucleotide
tgtctgctgatctatctgtt

SEQ ID NO: 2997 - DNA, 20 bp, Artificial sequence
  Synthetic oligonucleotide
ttagggctgccttccatctg

SEQ ID NO: 2998 - DNA, 20 bp, Artificial sequence
  Synthetic oligonucleotide
cagctgactttaccccaagc

SEQ ID NO: 2999 - DNA, 20 bp, Artificial sequence
  Synthetic oligonucleotide
gcatttaagaaatgctcaaa

SEQ ID NO: 3000 - DNA, 20 bp, Artificial sequence
  Synthetic oligonucleotide
gtttattttccatgtgtcac

SEQ ID NO: 3001 - DNA, 20 bp, Artificial sequence
  Synthetic oligonucleotide
ctccccaagaacagaagagg

SEQ ID NO: 3002 - DNA, 20 bp, Artificial sequence
  Synthetic oligonucleotide
aggaagattcttcaggctag

SEQ ID NO: 3003 - DNA, 20 bp, Artificial sequence
  Synthetic oligonucleotide
agacccaaatccgcacccct

SEQ ID NO: 3004 - DNA, 20 bp, Artificial sequence
  Synthetic oligonucleotide
tccccaaactaaacacccct

SEQ ID NO: 3005 - DNA, 20 bp, Artificial sequence
  Synthetic oligonucleotide
tacttcctacccaaggagga

SEQ ID NO: 3006 - DNA, 20 bp, Artificial sequence
  Synthetic oligonucleotide
ggattccaccccgaggatta

SEQ ID NO: 3007 - DNA, 20 bp, Artificial sequence
  Synthetic oligonucleotide
ccctaataacacagagcctg

SEQ ID NO: 3008 - DNA, 20 bp, Artificial sequence
  Synthetic oligonucleotide
gcagtcaccaactatctatt

SEQ ID NO: 3009 - DNA, 20 bp, Artificial sequence
  Synthetic oligonucleotide
atcagttgtaaccaatctat

SEQ ID NO: 3010 - DNA, 20 bp, Artificial sequence
  Synthetic oligonucleotide
tcagtaaacccacaccctag

SEQ ID NO: 3011 - DNA, 20 bp, Artificial sequence
  Synthetic oligonucleotide
ggcgaaattattaaattggg

SEQ ID NO: 3012 - DNA, 20 bp, Artificial sequence
  Synthetic oligonucleotide
tttgattgtatatttcaatc

SEQ ID NO: 3013 - DNA, 20 bp, Artificial sequence
  Synthetic oligonucleotide
gatggacgaacctagacagg

SEQ ID NO: 3014 - DNA, 20 bp, Artificial sequence
  Synthetic oligonucleotide
atcctgtttcaaacacccta

SEQ ID NO: 3015 - DNA, 20 bp, Artificial sequence
  Synthetic oligonucleotide
ttttattgaatcacacttca

SEQ ID NO: 3016 - DNA, 20 bp, Artificial sequence
  Synthetic oligonucleotide
tccctcttcccatcctgcca

SEQ ID NO: 3017 - DNA, 20 bp, Artificial sequence
  Synthetic oligonucleotide
gcatgtgccccttactccct

SEQ ID NO: 3018 - DNA, 20 bp, Artificial sequence
  Synthetic oligonucleotide
tcccatgttcttccccatct

SEQ ID NO: 3019 - DNA, 20 bp, Artificial sequence
  Synthetic oligonucleotide
agcttcaaaatattgttatt

SEQ ID NO: 3020 - DNA, 20 bp, Artificial sequence
  Synthetic oligonucleotide
ataaggatataaacattctt

SEQ ID NO: 3021 - DNA, 20 bp, Artificial sequence
  Synthetic oligonucleotide
ggagcggaagattattcaga

SEQ ID NO: 3022 - DNA, 20 bp, Artificial sequence
  Synthetic oligonucleotide
ctccaaatctccaaagacag

SEQ ID NO: 3023 - DNA, 20 bp, Artificial sequence
  Synthetic oligonucleotide
ttcttgaaccctcactggtg

SEQ ID NO: 3024 - DNA, 20 bp, Artificial sequence
  Synthetic oligonucleotide
ccgcatctcaaaactccaaa

SEQ ID NO: 3025 - DNA, 20 bp, Artificial sequence
  Synthetic oligonucleotide
ggtgtgtgagccacattata

SEQ ID NO: 3026 - DNA, 20 bp, Artificial sequence
  Synthetic oligonucleotide
ggctccatagatcctcttgc

SEQ ID NO: 3027 - DNA, 20 bp, Artificial sequence
  Synthetic oligonucleotide
tgacctctacccttgtgagc

SEQ ID NO: 3028 - DNA, 20 bp, Artificial sequence
  Synthetic oligonucleotide
tgttgcttttctacttcatc

SEQ ID NO: 3029 - DNA, 20 bp, Artificial sequence
  Synthetic oligonucleotide
ctctagaacaaaatacatat

SEQ ID NO: 3030 - DNA, 20 bp, Artificial sequence
  Synthetic oligonucleotide
tctgtttttaaaagatccat

SEQ ID NO: 3031 - DNA, 20 bp, Artificial sequence
  Synthetic oligonucleotide
aacaggcctttcaaggtctg

SEQ ID NO: 3032 - DNA, 20 bp, Artificial sequence
  Synthetic oligonucleotide
agtgtgtttatcactgagtc

SEQ ID NO: 3033 - DNA, 20 bp, Artificial sequence
  Synthetic oligonucleotide
cttgtttgattttatgcaca

SEQ ID NO: 3034 - DNA, 20 bp, Artificial sequence
  Synthetic oligonucleotide
atcttctgtttttaagtctt

SEQ ID NO: 3035 - DNA, 20 bp, Artificial sequence
  Synthetic oligonucleotide
tgcaggcaatcccattttct

SEQ ID NO: 3036 - DNA, 20 bp, Artificial sequence
  Synthetic oligonucleotide
ttggagagaaaaatgttctt

SEQ ID NO: 3037 - DNA, 20 bp, Artificial sequence
  Synthetic oligonucleotide
atgctcatcttcaaaatcta

SEQ ID NO: 3038 - DNA, 20 bp, Artificial sequence
  Synthetic oligonucleotide
tggtcatttattgtcacata

SEQ ID NO: 3039 - DNA, 20 bp, Artificial sequence
  Synthetic oligonucleotide
tgctcacatatataaatgtc

SEQ ID NO: 3040 - DNA, 20 bp, Artificial sequence
  Synthetic oligonucleotide
gttgataccagatttttttt

SEQ ID NO: 3041 - DNA, 20 bp, Artificial sequence
  Synthetic oligonucleotide
agtcaattcaatactcgaag

SEQ ID NO: 3042 - DNA, 20 bp, Artificial sequence
  Synthetic oligonucleotide
tccacattcactattccgtg

SEQ ID NO: 3043 - DNA, 20 bp, Artificial sequence
  Synthetic oligonucleotide
acagtcattttatatattta

SEQ ID NO: 3044 - DNA, 20 bp, Artificial sequence
  Synthetic oligonucleotide
caggaaatccaaacattcct

SEQ ID NO: 3045 - DNA, 20 bp, Artificial sequence
  Synthetic oligonucleotide
tcacatcaccaccgaagaaa

SEQ ID NO: 3046 - DNA, 20 bp, Artificial sequence
  Synthetic oligonucleotide
ttggagtttccctatgccag

SEQ ID NO: 3047 - DNA, 20 bp, Artificial sequence
  Synthetic oligonucleotide
gacaaatttctatatacaaa

SEQ ID NO: 3048 - DNA, 20 bp, Artificial sequence
  Synthetic oligonucleotide
actccccccatttaaatgag

SEQ ID NO: 3049 - DNA, 20 bp, Artificial sequence
  Synthetic oligonucleotide
gcacttaattttaatacagt

SEQ ID NO: 3050 - DNA, 20 bp, Artificial sequence
  Synthetic oligonucleotide
ggcagtattcacagaactga

SEQ ID NO: 3051 - DNA, 20 bp, Artificial sequence
  Synthetic oligonucleotide
cttaactattatgtatgcac

SEQ ID NO: 3052 - DNA, 20 bp, Artificial sequence
  Synthetic oligonucleotide
ttgttttattataataatga

SEQ ID NO: 3053 - DNA, 20 bp, Artificial sequence
  Synthetic oligonucleotide
gcaggtaaaaccaaatgaca

SEQ ID NO: 3054 - DNA, 20 bp, Artificial sequence
  Synthetic oligonucleotide
gcaaccaaaaccaaaagcct

SEQ ID NO: 3055 - DNA, 20 bp, Artificial sequence
  Synthetic oligonucleotide
gggctattaatttattaaat

SEQ ID NO: 3056 - DNA, 20 bp, Artificial sequence
  Synthetic oligonucleotide
aagatcttttaaagtcctac

SEQ ID NO: 3057 - DNA, 20 bp, Artificial sequence
  Synthetic oligonucleotide
gtaagctccatttatagaat

SEQ ID NO: 3058 - DNA, 20 bp, Artificial sequence
  Synthetic oligonucleotide
cctcacacaccttaaccctg

SEQ ID NO: 3059 - DNA, 20 bp, Artificial sequence
  Synthetic oligonucleotide
gagataaaaattattttggc

SEQ ID NO: 3060 - DNA, 20 bp, Artificial sequence
  Synthetic oligonucleotide
gctaaatttcattagaaaca

SEQ ID NO: 3061 - DNA, 20 bp, Artificial sequence
  Synthetic oligonucleotide
ttttctacaatttataggcg

SEQ ID NO: 3062 - DNA, 20 bp, Artificial sequence
  Synthetic oligonucleotide
ctgcaccaaatttatttttg

SEQ ID NO: 3063 - DNA, 20 bp, Artificial sequence
  Synthetic oligonucleotide
actgaaaaaactgtatgatc

SEQ ID NO: 3064 - DNA, 20 bp, Artificial sequence
  Synthetic oligonucleotide
ccttttaaaatttccagaaa

SEQ ID NO: 3065 - DNA, 20 bp, Artificial sequence
  Synthetic oligonucleotide
gaagttagccaggcatcagg

SEQ ID NO: 3066 - DNA, 20 bp, Artificial sequence
  Synthetic oligonucleotide
gcagagttttaaaatgcact

SEQ ID NO: 3067 - DNA, 20 bp, Artificial sequence
  Synthetic oligonucleotide
aggcatagtatttagcagaa

SEQ ID NO: 3068 - DNA, 20 bp, Artificial sequence
  Synthetic oligonucleotide
tacttctttccttaagcaca

SEQ ID NO: 3069 - DNA, 20 bp, Artificial sequence
  Synthetic oligonucleotide
tagtttaaaatatgtgactc

SEQ ID NO: 3070 - DNA, 20 bp, Artificial sequence
  Synthetic oligonucleotide
ccagaaaaaccttaaactac

SEQ ID NO: 3071 - DNA, 20 bp, Artificial sequence
  Synthetic oligonucleotide
accttcaaactatcaattct

SEQ ID NO: 3072 - DNA, 20 bp, Artificial sequence
  Synthetic oligonucleotide
ttcctcatcttaatcacaga

SEQ ID NO: 3073 - DNA, 20 bp, Artificial sequence
  Synthetic oligonucleotide
gagagtataaaaattatctc

SEQ ID NO: 3074 - DNA, 20 bp, Artificial sequence
  Synthetic oligonucleotide
gtccatcacacttagggctg

SEQ ID NO: 3075 - DNA, 20 bp, Artificial sequence
  Synthetic oligonucleotide
ctacagctgactttacccca

SEQ ID NO: 3076 - DNA, 20 bp, Artificial sequence
  Synthetic oligonucleotide
ttgggcatttaagaaatgct

SEQ ID NO: 3077 - DNA, 20 bp, Artificial sequence
  Synthetic oligonucleotide
atgtttattttccatgtgtc

SEQ ID NO: 3078 - DNA, 20 bp, Artificial sequence
  Synthetic oligonucleotide
cttcctccccaagaacagaa

SEQ ID NO: 3079 - DNA, 20 bp, Artificial sequence
  Synthetic oligonucleotide
cagtgcctaaccagttgaga

SEQ ID NO: 3080 - DNA, 20 bp, Artificial sequence
  Synthetic oligonucleotide
ccagagacccaaatccgcac

SEQ ID NO: 3081 - DNA, 20 bp, Artificial sequence
  Synthetic oligonucleotide
catccccaaactaaacaccc

SEQ ID NO: 3082 - DNA, 20 bp, Artificial sequence
  Synthetic oligonucleotide
ctaacctacttcctacccaa

SEQ ID NO: 3083 - DNA, 20 bp, Artificial sequence
  Synthetic oligonucleotide
agccttagaaacaggaacgg

SEQ ID NO: 3084 - DNA, 20 bp, Artificial sequence
  Synthetic oligonucleotide
gccctaataacacagagcct

SEQ ID NO: 3085 - DNA, 20 bp, Artificial sequence
  Synthetic oligonucleotide
cggcacaaatccagggctgg

SEQ ID NO: 3086 - DNA, 20 bp, Artificial sequence
  Synthetic oligonucleotide
tagttaaaaataaggtatcg

SEQ ID NO: 3087 - DNA, 20 bp, Artificial sequence
  Synthetic oligonucleotide
ttcagtaaacccacacccta

SEQ ID NO: 3088 - DNA, 20 bp, Artificial sequence
  Synthetic oligonucleotide
tggcgaaattattaaattgg

SEQ ID NO: 3089 - DNA, 20 bp, Artificial sequence
  Synthetic oligonucleotide
cacgcatatttatgctgttt

SEQ ID NO: 3090 - DNA, 20 bp, Artificial sequence
  Synthetic oligonucleotide
ggatggacgaacctagacag

SEQ ID NO: 3091 - DNA, 20 bp, Artificial sequence
  Synthetic oligonucleotide
atatcctgtttcaaacaccc

SEQ ID NO: 3092 - DNA, 20 bp, Artificial sequence
  Synthetic oligonucleotide
gattttattgaatcacactt

SEQ ID NO: 3093 - DNA, 20 bp, Artificial sequence
  Synthetic oligonucleotide
caaccattccagactgagct

SEQ ID NO: 3094 - DNA, 20 bp, Artificial sequence
  Synthetic oligonucleotide
acatgcaagcctgatgtggt

SEQ ID NO: 3095 - DNA, 20 bp, Artificial sequence
  Synthetic oligonucleotide
ctaaaacacaccagacctcc

SEQ ID NO: 3096 - DNA, 20 bp, Artificial sequence
  Synthetic oligonucleotide
tagcttcaaaatattgttat

SEQ ID NO: 3097 - DNA, 20 bp, Artificial sequence
  Synthetic oligonucleotide
taggtttgtcataaggatat

SEQ ID NO: 3098 - DNA, 20 bp, Artificial sequence
  Synthetic oligonucleotide
gccacgaccagatatcagct

SEQ ID NO: 3099 - DNA, 20 bp, Artificial sequence
  Synthetic oligonucleotide
actccaaatctccaaagaca

SEQ ID NO: 3100 - DNA, 20 bp, Artificial sequence
  Synthetic oligonucleotide
cttcttgaaccctcactggt

SEQ ID NO: 3101 - DNA, 20 bp, Artificial sequence
  Synthetic oligonucleotide
tccgcatctcaaaactccaa

SEQ ID NO: 3102 - DNA, 20 bp, Artificial sequence
  Synthetic oligonucleotide
ggacacctacccatggagag

SEQ ID NO: 3103 - DNA, 20 bp, Artificial sequence
  Synthetic oligonucleotide
actgtattctaagtaggagg

SEQ ID NO: 3104 - DNA, 20 bp, Artificial sequence
  Synthetic oligonucleotide
cctcctgacctctacccttg

SEQ ID NO: 3105 - DNA, 20 bp, Artificial sequence
  Synthetic oligonucleotide
gatttccacagattgttgct

SEQ ID NO: 3106 - DNA, 20 bp, Artificial sequence
  Synthetic oligonucleotide
cctctagaacaaaatacata

SEQ ID NO: 3107 - DNA, 20 bp, Artificial sequence
  Synthetic oligonucleotide
atctgtttttaaaagatcca

SEQ ID NO: 3108 - DNA, 20 bp, Artificial sequence
  Synthetic oligonucleotide
aaccacaagccaacaggcct

SEQ ID NO: 3109 - DNA, 20 bp, Artificial sequence
  Synthetic oligonucleotide
tgtgagttccaagaagcagg

SEQ ID NO: 3110 - DNA, 20 bp, Artificial sequence
  Synthetic oligonucleotide
cattttattcttgtttgatt

SEQ ID NO: 3111 - DNA, 20 bp, Artificial sequence
  Synthetic oligonucleotide
ctgttgctctggctgctgct

SEQ ID NO: 3112 - DNA, 20 bp, Artificial sequence
  Synthetic oligonucleotide
ttgcggctgctgttgctctg

SEQ ID NO: 3113 - DNA, 20 bp, Artificial sequence
  Synthetic oligonucleotide
caatgtcttgcggctgctgt

SEQ ID NO: 3114 - DNA, 20 bp, Artificial sequence
  Synthetic oligonucleotide
cctggtgacttgatgcacga

SEQ ID NO: 3115 - DNA, 20 bp, Artificial sequence
  Synthetic oligonucleotide
atcagttccttgcagcagat

SEQ ID NO: 3116 - DNA, 20 bp, Artificial sequence
  Synthetic oligonucleotide
ccataagctatcagttcctt

SEQ ID NO: 3117 - DNA, 20 bp, Artificial sequence
  Synthetic oligonucleotide
tggagaaccataagctatca

SEQ ID NO: 3118 - DNA, 20 bp, Artificial sequence
  Synthetic oligonucleotide
catgtgctttcatcacaatg

SEQ ID NO: 3119 - DNA, 20 bp, Artificial sequence
  Synthetic oligonucleotide
ctgtaccatgtgctttcatc

SEQ ID NO: 3120 - DNA, 20 bp, Artificial sequence
  Synthetic oligonucleotide
taaatactgtgttattttag

SEQ ID NO: 3121 - DNA, 20 bp, Artificial sequence
  Synthetic oligonucleotide
ggtatttgttcagtttagtt

SEQ ID NO: 3122 - DNA, 20 bp, Artificial sequence
  Synthetic oligonucleotide
aagtcaggtatttgttcagt

SEQ ID NO: 3123 - DNA, 20 bp, Artificial sequence
  Synthetic oligonucleotide
gtttagtggatccagtcaat

SEQ ID NO: 3124 - DNA, 20 bp, Artificial sequence
  Synthetic oligonucleotide
agtgttggtttagtggatcc

SEQ ID NO: 3125 - DNA, 20 bp, Artificial sequence
  Synthetic oligonucleotide
tcccatcttagtgttggttt

SEQ ID NO: 3126 - DNA, 20 bp, Artificial sequence
  Synthetic oligonucleotide
ttagagattgttgttattgt

SEQ ID NO: 3127 - DNA, 20 bp, Artificial sequence
  Synthetic oligonucleotide
aaattcttagagattgttgt

SEQ ID NO: 3128 - DNA, 20 bp, Artificial sequence
  Synthetic oligonucleotide
tgatctgatattaaaacatc

SEQ ID NO: 3129 - DNA, 20 bp, Artificial sequence
  Synthetic oligonucleotide
tgggtaatgatctgatatta

SEQ ID NO: 3130 - DNA, 20 bp, Artificial sequence
  Synthetic oligonucleotide
ggcatatggtgggtaatgat

SEQ ID NO: 3131 - DNA, 20 bp, Artificial sequence
  Synthetic oligonucleotide
agtagtttttgtgaggtaaa

SEQ ID NO: 3132 - DNA, 20 bp, Artificial sequence
  Synthetic oligonucleotide
gcttgtagtagtttttgtga

SEQ ID NO: 3133 - DNA, 20 bp, Artificial sequence
  Synthetic oligonucleotide
ttttctatttgcactagctg

SEQ ID NO: 3134 - DNA, 20 bp, Artificial sequence
  Synthetic oligonucleotide
atgtcaccttttctatttgc

SEQ ID NO: 3135 - DNA, 20 bp, Artificial sequence
  Synthetic oligonucleotide
aaacactagaaatccaggga

SEQ ID NO: 3136 - DNA, 20 bp, Artificial sequence
  Synthetic oligonucleotide
tgctatgctcacagagaacc

SEQ ID NO: 3137 - DNA, 20 bp, Artificial sequence
  Synthetic oligonucleotide
tacagttagtttgatatgct

SEQ ID NO: 3138 - DNA, 20 bp, Artificial sequence
  Synthetic oligonucleotide
ggaataaattatttactgcg

SEQ ID NO: 3139 - DNA, 20 bp, Artificial sequence
  Synthetic oligonucleotide
tactatgtatttgccacagt

SEQ ID NO: 3140 - DNA, 20 bp, Artificial sequence
  Synthetic oligonucleotide
atatttaatcatgttcccga

SEQ ID NO: 3141 - DNA, 20 bp, Artificial sequence
  Synthetic oligonucleotide
atagttatatttaatcatgt

SEQ ID NO: 3142 - DNA, 20 bp, Artificial sequence
  Synthetic oligonucleotide
atatgtatacaattctgaca

SEQ ID NO: 3143 - DNA, 20 bp, Artificial sequence
  Synthetic oligonucleotide
caatgttctcaggtttatat

SEQ ID NO: 3144 - DNA, 20 bp, Artificial sequence
  Synthetic oligonucleotide
cctttcttctttgttcatag

SEQ ID NO: 3145 - DNA, 20 bp, Artificial sequence
  Synthetic oligonucleotide
cttgttcctttcttctttgt

SEQ ID NO: 3146 - DNA, 20 bp, Artificial sequence
  Synthetic oligonucleotide
atttatcctcaggatgcaaa

SEQ ID NO: 3147 - DNA, 20 bp, Artificial sequence
  Synthetic oligonucleotide
tttgtttagatttatcctca

SEQ ID NO: 3148 - DNA, 20 bp, Artificial sequence
  Synthetic oligonucleotide
atactccatttttccttcta

SEQ ID NO: 3149 - DNA, 20 bp, Artificial sequence
  Synthetic oligonucleotide
atgtgtaatactccattttt

SEQ ID NO: 3150 - DNA, 20 bp, Artificial sequence
  Synthetic oligonucleotide
ttattacaaatgtgtaatac

SEQ ID NO: 3151 - DNA, 20 bp, Artificial sequence
  Synthetic oligonucleotide
tatgttagtcatttctctct

SEQ ID NO: 3152 - DNA, 20 bp, Artificial sequence
  Synthetic oligonucleotide
caagtctatgttagtcattt

SEQ ID NO: 3153 - DNA, 20 bp, Artificial sequence
  Synthetic oligonucleotide
taaggtattttcatggagtt

SEQ ID NO: 3154 - DNA, 20 bp, Artificial sequence
  Synthetic oligonucleotide
ttgtaacagttatgtttaag

SEQ ID NO: 3155 - DNA, 20 bp, Artificial sequence
  Synthetic oligonucleotide
tttactcattctaccttcaa

SEQ ID NO: 3156 - DNA, 20 bp, Artificial sequence
  Synthetic oligonucleotide
ttggttatttactcattcta

SEQ ID NO: 3157 - DNA, 20 bp, Artificial sequence
  Synthetic oligonucleotide
tccataaacttggttattta

SEQ ID NO: 3158 - DNA, 20 bp, Artificial sequence
  Synthetic oligonucleotide
ttagcttttcaaatactaaa

SEQ ID NO: 3159 - DNA, 20 bp, Artificial sequence
  Synthetic oligonucleotide
tcagcatacttagcttttca

SEQ ID NO: 3160 - DNA, 20 bp, Artificial sequence
  Synthetic oligonucleotide
gacagtgtcagcatacttag

SEQ ID NO: 3161 - DNA, 20 bp, Artificial sequence
  Synthetic oligonucleotide
tacccaggttattacactgt

SEQ ID NO: 3162 - DNA, 20 bp, Artificial sequence
  Synthetic oligonucleotide
ttgggtttttctgtacaaag

SEQ ID NO: 3163 - DNA, 20 bp, Artificial sequence
  Synthetic oligonucleotide
ttttgtttgggtttttctgt

SEQ ID NO: 3164 - DNA, 20 bp, Artificial sequence
  Synthetic oligonucleotide
ctagttcttatcactattca

SEQ ID NO: 3165 - DNA, 20 bp, Artificial sequence
  Synthetic oligonucleotide
atgtcaactagttcttatca

SEQ ID NO: 3166 - DNA, 20 bp, Artificial sequence
  Synthetic oligonucleotide
gactaaacaatgtcaactag

SEQ ID NO: 3167 - DNA, 20 bp, Artificial sequence
  Synthetic oligonucleotide
tgggtttttagttttccttc

SEQ ID NO: 3168 - DNA, 20 bp, Artificial sequence
  Synthetic oligonucleotide
aggtcctgggtttttagttt

SEQ ID NO: 3169 - DNA, 20 bp, Artificial sequence
  Synthetic oligonucleotide
taaatgactgtggtgcagcc

SEQ ID NO: 3170 - DNA, 20 bp, Artificial sequence
  Synthetic oligonucleotide
aagccagtgtttgcattaaa

SEQ ID NO: 3171 - DNA, 20 bp, Artificial sequence
  Synthetic oligonucleotide
aagggccactaaatctgacc

SEQ ID NO: 3172 - DNA, 20 bp, Artificial sequence
  Synthetic oligonucleotide
atttcttttttttttaagtt

SEQ ID NO: 3173 - DNA, 20 bp, Artificial sequence
  Synthetic oligonucleotide
gtgtttgatatttctttttt

SEQ ID NO: 3174 - DNA, 20 bp, Artificial sequence
  Synthetic oligonucleotide
ctttcaaatgtgtttgatat

SEQ ID NO: 3175 - DNA, 20 bp, Artificial sequence
  Synthetic oligonucleotide
ttataacaatttgcatagtc

SEQ ID NO: 3176 - DNA, 20 bp, Artificial sequence
  Synthetic oligonucleotide
gggagtattataacaatttg

SEQ ID NO: 3177 - DNA, 20 bp, Artificial sequence
  Synthetic oligonucleotide
tattttccagggagtattat

SEQ ID NO: 3178 - DNA, 20 bp, Artificial sequence
  Synthetic oligonucleotide
cattatctagtttctggaaa

SEQ ID NO: 3179 - DNA, 20 bp, Artificial sequence
  Synthetic oligonucleotide
aatggtcattatctagtttc

SEQ ID NO: 3180 - DNA, 20 bp, Artificial sequence
  Synthetic oligonucleotide
ctaaatctgacttacaaagg

SEQ ID NO: 3181 - DNA, 20 bp, Artificial sequence
  Synthetic oligonucleotide
taaaaccaatacattaacat

SEQ ID NO: 3182 - DNA, 20 bp, Artificial sequence
  Synthetic oligonucleotide
cattatgctttaagatcaca

SEQ ID NO: 3183 - DNA, 20 bp, Artificial sequence
  Synthetic oligonucleotide
aacaatgtcttgcggctgct

SEQ ID NO: 3184 - DNA, 20 bp, Artificial sequence
  Synthetic oligonucleotide
tgacttgatgcacgatgctc

SEQ ID NO: 3185 - DNA, 20 bp, Artificial sequence
  Synthetic oligonucleotide
ccctggtgacttgatgcacg

SEQ ID NO: 3186 - DNA, 20 bp, Artificial sequence
  Synthetic oligonucleotide
ctatcagttccttgcagcag

SEQ ID NO: 3187 - DNA, 20 bp, Artificial sequence
  Synthetic oligonucleotide
aatggagaaccataagctat

SEQ ID NO: 3188 - DNA, 20 bp, Artificial sequence
  Synthetic oligonucleotide
ccatgtgctttcatcacaat

SEQ ID NO: 3189 - DNA, 20 bp, Artificial sequence
  Synthetic oligonucleotide
actgtaccatgtgctttcat

SEQ ID NO: 3190 - DNA, 20 bp, Artificial sequence
  Synthetic oligonucleotide
ttcagtttagttgcagccat

SEQ ID NO: 3191 - DNA, 20 bp, Artificial sequence
  Synthetic oligonucleotide
aggtatttgttcagtttagt

SEQ ID NO: 3192 - DNA, 20 bp, Artificial sequence
  Synthetic oligonucleotide
aaaagtcaggtatttgttca

SEQ ID NO: 3193 - DNA, 20 bp, Artificial sequence
  Synthetic oligonucleotide
tggtttagtggatccagtca

SEQ ID NO: 3194 - DNA, 20 bp, Artificial sequence
  Synthetic oligonucleotide
tagtgttggtttagtggatc

SEQ ID NO: 3195 - DNA, 20 bp, Artificial sequence
  Synthetic oligonucleotide
tgttgttattgtatagatac

SEQ ID NO: 3196 - DNA, 20 bp, Artificial sequence
  Synthetic oligonucleotide
cttagagattgttgttattg

SEQ ID NO: 3197 - DNA, 20 bp, Artificial sequence
  Synthetic oligonucleotide
ggaaattcttagagattgtt

SEQ ID NO: 3198 - DNA, 20 bp, Artificial sequence
  Synthetic oligonucleotide
aatgatctgatattaaaaca

SEQ ID NO: 3199 - DNA, 20 bp, Artificial sequence
  Synthetic oligonucleotide
gtgggtaatgatctgatatt

SEQ ID NO: 3200 - DNA, 20 bp, Artificial sequence
  Synthetic oligonucleotide
ttgtgaggtaaaactgtaaa

SEQ ID NO: 3201 - DNA, 20 bp, Artificial sequence
  Synthetic oligonucleotide
tagtagtttttgtgaggtaa

SEQ ID NO: 3202 - DNA, 20 bp, Artificial sequence
  Synthetic oligonucleotide
ccttttctatttgcactagc

SEQ ID NO: 3203 - DNA, 20 bp, Artificial sequence
  Synthetic oligonucleotide
aatgtcaccttttctatttg

SEQ ID NO: 3204 - DNA, 20 bp, Artificial sequence
  Synthetic oligonucleotide
aactctcttaagtacttata

SEQ ID NO: 3205 - DNA, 20 bp, Artificial sequence
  Synthetic oligonucleotide
tatgctatgctcacagagaa

SEQ ID NO: 3206 - DNA, 20 bp, Artificial sequence
  Synthetic oligonucleotide
agtttgatatgctatgctca

SEQ ID NO: 3207 - DNA, 20 bp, Artificial sequence
  Synthetic oligonucleotide
cttacagttagtttgatatg

SEQ ID NO: 3208 - DNA, 20 bp, Artificial sequence
  Synthetic oligonucleotide
agcttccagataaaacctcc

SEQ ID NO: 3209 - DNA, 20 bp, Artificial sequence
  Synthetic oligonucleotide
ttcaaaattctcagcattgg

SEQ ID NO: 3210 - DNA, 20 bp, Artificial sequence
  Synthetic oligonucleotide
tatatttaatcatgttcccg

SEQ ID NO: 3211 - DNA, 20 bp, Artificial sequence
  Synthetic oligonucleotide
ttatatgtatacaattctga

SEQ ID NO: 3212 - DNA, 20 bp, Artificial sequence
  Synthetic oligonucleotide
ctcaggtttatatgtataca

SEQ ID NO: 3213 - DNA, 20 bp, Artificial sequence
  Synthetic oligonucleotide
ggcaatgttctcaggtttat

SEQ ID NO: 3214 - DNA, 20 bp, Artificial sequence
  Synthetic oligonucleotide
tcctttcttctttgttcata

SEQ ID NO: 3215 - DNA, 20 bp, Artificial sequence
  Synthetic oligonucleotide
tcttgttcctttcttctttg

SEQ ID NO: 3216 - DNA, 20 bp, Artificial sequence
  Synthetic oligonucleotide
agatttatcctcaggatgca

SEQ ID NO: 3217 - DNA, 20 bp, Artificial sequence
  Synthetic oligonucleotide
taatactccatttttccttc

SEQ ID NO: 3218 - DNA, 20 bp, Artificial sequence
  Synthetic oligonucleotide
aatgtgtaatactccatttt

SEQ ID NO: 3219 - DNA, 20 bp, Artificial sequence
  Synthetic oligonucleotide
tcatttctctctggctgtgc

SEQ ID NO: 3220 - DNA, 20 bp, Artificial sequence
  Synthetic oligonucleotide
ctatgttagtcatttctctc

SEQ ID NO: 3221 - DNA, 20 bp, Artificial sequence
  Synthetic oligonucleotide
atcaagtctatgttagtcat

SEQ ID NO: 3222 - DNA, 20 bp, Artificial sequence
  Synthetic oligonucleotide
tttaaggtattttcatggag

SEQ ID NO: 3223 - DNA, 20 bp, Artificial sequence
  Synthetic oligonucleotide
agttatgtttaaggtatttt

SEQ ID NO: 3224 - DNA, 20 bp, Artificial sequence
  Synthetic oligonucleotide
acttgtaacagttatgttta

SEQ ID NO: 3225 - DNA, 20 bp, Artificial sequence
  Synthetic oligonucleotide
tatttactcattctaccttc

SEQ ID NO: 3226 - DNA, 20 bp, Artificial sequence
  Synthetic oligonucleotide
cttggttatttactcattct

SEQ ID NO: 3227 - DNA, 20 bp, Artificial sequence
  Synthetic oligonucleotide
ggctgattctagtactgtga

SEQ ID NO: 3228 - DNA, 20 bp, Artificial sequence
  Synthetic oligonucleotide
acttagcttttcaaatacta

SEQ ID NO: 3229 - DNA, 20 bp, Artificial sequence
  Synthetic oligonucleotide
aggacagtgtcagcatactt

SEQ ID NO: 3230 - DNA, 20 bp, Artificial sequence
  Synthetic oligonucleotide
ttctgtacaaagttcagttg

SEQ ID NO: 3231 - DNA, 20 bp, Artificial sequence
  Synthetic oligonucleotide
tttgggtttttctgtacaaa

SEQ ID NO: 3232 - DNA, 20 bp, Artificial sequence
  Synthetic oligonucleotide
agttttgtttgggtttttct

SEQ ID NO: 3233 - DNA, 20 bp, Artificial sequence
  Synthetic oligonucleotide
aactagttcttatcactatt

SEQ ID NO: 3234 - DNA, 20 bp, Artificial sequence
  Synthetic oligonucleotide
aatgtcaactagttcttatc

SEQ ID NO: 3235 - DNA, 20 bp, Artificial sequence
  Synthetic oligonucleotide
tataaaattcacctaaaatt

SEQ ID NO: 3236 - DNA, 20 bp, Artificial sequence
  Synthetic oligonucleotide
ctgggtttttagttttcctt

SEQ ID NO: 3237 - DNA, 20 bp, Artificial sequence
  Synthetic oligonucleotide
taggtcctgggtttttagtt

SEQ ID NO: 3238 - DNA, 20 bp, Artificial sequence
  Synthetic oligonucleotide
attaaatgactgtggtgcag

SEQ ID NO: 3239 - DNA, 20 bp, Artificial sequence
  Synthetic oligonucleotide
tgtttgcattaaatgactgt

SEQ ID NO: 3240 - DNA, 20 bp, Artificial sequence
  Synthetic oligonucleotide
aaaagccagtgtttgcatta

SEQ ID NO: 3241 - DNA, 20 bp, Artificial sequence
  Synthetic oligonucleotide
taagggccactaaatctgac

SEQ ID NO: 3242 - DNA, 20 bp, Artificial sequence
  Synthetic oligonucleotide
atatttcttttttttttaag

SEQ ID NO: 3243 - DNA, 20 bp, Artificial sequence
  Synthetic oligonucleotide
tgtgtttgatatttcttttt

SEQ ID NO: 3244 - DNA, 20 bp, Artificial sequence
  Synthetic oligonucleotide
atgcaaggtccagggaatac

SEQ ID NO: 3245 - DNA, 20 bp, Artificial sequence
  Synthetic oligonucleotide
tattataacaatttgcatag

SEQ ID NO: 3246 - DNA, 20 bp, Artificial sequence
  Synthetic oligonucleotide
agggagtattataacaattt

SEQ ID NO: 3247 - DNA, 20 bp, Artificial sequence
  Synthetic oligonucleotide
tatgagtaattagcacaaag

SEQ ID NO: 3248 - DNA, 20 bp, Artificial sequence
  Synthetic oligonucleotide
tcattatctagtttctggaa

SEQ ID NO: 3249 - DNA, 20 bp, Artificial sequence
  Synthetic oligonucleotide
aaatggtcattatctagttt

SEQ ID NO: 3250 - DNA, 20 bp, Artificial sequence
  Synthetic oligonucleotide
acttccaattttgaaatact

SEQ ID NO: 3251 - DNA, 20 bp, Artificial sequence
  Synthetic oligonucleotide
gaaagccccagcacataaat

SEQ ID NO: 3252 - DNA, 20 bp, Artificial sequence
  Synthetic oligonucleotide
tgaaagctggccgatatccc

SEQ ID NO: 3253 - DNA, 20 bp, Artificial sequence
  Synthetic oligonucleotide
tcttgcggctgctgttgctc

SEQ ID NO: 3254 - DNA, 20 bp, Artificial sequence
  Synthetic oligonucleotide
gaaacaatgtcttgcggctg

SEQ ID NO: 3255 - DNA, 20 bp, Artificial sequence
  Synthetic oligonucleotide
gtgacttgatgcacgatgct

SEQ ID NO: 3256 - DNA, 20 bp, Artificial sequence
  Synthetic oligonucleotide
accctggtgacttgatgcac

SEQ ID NO: 3257 - DNA, 20 bp, Artificial sequence
  Synthetic oligonucleotide
agctatcagttccttgcagc

SEQ ID NO: 3258 - DNA, 20 bp, Artificial sequence
  Synthetic oligonucleotide
aaccataagctatcagttcc

SEQ ID NO: 3259 - DNA, 20 bp, Artificial sequence
  Synthetic oligonucleotide
acaatggagaaccataagct

SEQ ID NO: 3260 - DNA, 20 bp, Artificial sequence
  Synthetic oligonucleotide
accatgtgctttcatcacaa

SEQ ID NO: 3261 - DNA, 20 bp, Artificial sequence
  Synthetic oligonucleotide
aactgtaccatgtgctttca

SEQ ID NO: 3262 - DNA, 20 bp, Artificial sequence
  Synthetic oligonucleotide
agaaaagtcaggtatttgtt

SEQ ID NO: 3263 - DNA, 20 bp, Artificial sequence
  Synthetic oligonucleotide
ttggtttagtggatccagtc

SEQ ID NO: 3264 - DNA, 20 bp, Artificial sequence
  Synthetic oligonucleotide
ttagtgttggtttagtggat

SEQ ID NO: 3265 - DNA, 20 bp, Artificial sequence
  Synthetic oligonucleotide
attgttgttattgtatagat

SEQ ID NO: 3266 - DNA, 20 bp, Artificial sequence
  Synthetic oligonucleotide
atggaaattcttagagattg

SEQ ID NO: 3267 - DNA, 20 bp, Artificial sequence
  Synthetic oligonucleotide
taatgatctgatattaaaac

SEQ ID NO: 3268 - DNA, 20 bp, Artificial sequence
  Synthetic oligonucleotide
ggtgggtaatgatctgatat

SEQ ID NO: 3269 - DNA, 20 bp, Artificial sequence
  Synthetic oligonucleotide
ttttgtgaggtaaaactgta

SEQ ID NO: 3270 - DNA, 20 bp, Artificial sequence
  Synthetic oligonucleotide
accttttctatttgcactag

SEQ ID NO: 3271 - DNA, 20 bp, Artificial sequence
  Synthetic oligonucleotide
aaatgtcaccttttctattt

SEQ ID NO: 3272 - DNA, 20 bp, Artificial sequence
  Synthetic oligonucleotide
gctattttttccagaaagtc

SEQ ID NO: 3273 - DNA, 20 bp, Artificial sequence
  Synthetic oligonucleotide
gatatgctatgctcacagag

SEQ ID NO: 3274 - DNA, 20 bp, Artificial sequence
  Synthetic oligonucleotide
tagtttgatatgctatgctc

SEQ ID NO: 3275 - DNA, 20 bp, Artificial sequence
  Synthetic oligonucleotide
aattttttttaacatcttgc

SEQ ID NO: 3276 - DNA, 20 bp, Artificial sequence
  Synthetic oligonucleotide
atcatgttcccgatattgga

SEQ ID NO: 3277 - DNA, 20 bp, Artificial sequence
  Synthetic oligonucleotide
ttatatttaatcatgttccc

SEQ ID NO: 3278 - DNA, 20 bp, Artificial sequence
  Synthetic oligonucleotide
aacatagttatatttaatca

SEQ ID NO: 3279 - DNA, 20 bp, Artificial sequence
  Synthetic oligonucleotide
gtttatatgtatacaattct

SEQ ID NO: 3280 - DNA, 20 bp, Artificial sequence
  Synthetic oligonucleotide
tctcaggtttatatgtatac

SEQ ID NO: 3281 - DNA, 20 bp, Artificial sequence
  Synthetic oligonucleotide
tcacagggaataatgaagag

SEQ ID NO: 3282 - DNA, 20 bp, Artificial sequence
  Synthetic oligonucleotide
ttcctttcttctttgttcat

SEQ ID NO: 3283 - DNA, 20 bp, Artificial sequence
  Synthetic oligonucleotide
ctcttgttcctttcttcttt

SEQ ID NO: 3284 - DNA, 20 bp, Artificial sequence
  Synthetic oligonucleotide
ttagatttatcctcaggatg

SEQ ID NO: 3285 - DNA, 20 bp, Artificial sequence
  Synthetic oligonucleotide
ggtttgtttagatttatcct

SEQ ID NO: 3286 - DNA, 20 bp, Artificial sequence
  Synthetic oligonucleotide
gtaatactccatttttcctt

SEQ ID NO: 3287 - DNA, 20 bp, Artificial sequence
  Synthetic oligonucleotide
aaatgtgtaatactccattt

SEQ ID NO: 3288 - DNA, 20 bp, Artificial sequence
  Synthetic oligonucleotide
agtcatttctctctggctgt

SEQ ID NO: 3289 - DNA, 20 bp, Artificial sequence
  Synthetic oligonucleotide
aaatcaagtctatgttagtc

SEQ ID NO: 3290 - DNA, 20 bp, Artificial sequence
  Synthetic oligonucleotide
tgtttaaggtattttcatgg

SEQ ID NO: 3291 - DNA, 20 bp, Artificial sequence
  Synthetic oligonucleotide
cagttatgtttaaggtattt

SEQ ID NO: 3292 - DNA, 20 bp, Artificial sequence
  Synthetic oligonucleotide
ctgttcttagcttcccagct

SEQ ID NO: 3293 - DNA, 20 bp, Artificial sequence
  Synthetic oligonucleotide
ttatttactcattctacctt

SEQ ID NO: 3294 - DNA, 20 bp, Artificial sequence
  Synthetic oligonucleotide
acttggttatttactcattc

SEQ ID NO: 3295 - DNA, 20 bp, Artificial sequence
  Synthetic oligonucleotide
aatctccagttatgagtaag

SEQ ID NO: 3296 - DNA, 20 bp, Artificial sequence
  Synthetic oligonucleotide
atacttagcttttcaaatac

SEQ ID NO: 3297 - DNA, 20 bp, Artificial sequence
  Synthetic oligonucleotide
tgtcagcatacttagctttt

SEQ ID NO: 3298 - DNA, 20 bp, Artificial sequence
  Synthetic oligonucleotide
ccaggacagtgtcagcatac

SEQ ID NO: 3299 - DNA, 20 bp, Artificial sequence
  Synthetic oligonucleotide
ttttctgtacaaagttcagt

SEQ ID NO: 3300 - DNA, 20 bp, Artificial sequence
  Synthetic oligonucleotide
ttagttttgtttgggttttt

SEQ ID NO: 3301 - DNA, 20 bp, Artificial sequence
  Synthetic oligonucleotide
caactagttcttatcactat

SEQ ID NO: 3302 - DNA, 20 bp, Artificial sequence
  Synthetic oligonucleotide
caatgtcaactagttcttat

SEQ ID NO: 3303 - DNA, 20 bp, Artificial sequence
  Synthetic oligonucleotide
ttagttttccttcttgtctt

SEQ ID NO: 3304 - DNA, 20 bp, Artificial sequence
  Synthetic oligonucleotide
cctgggtttttagttttcct

SEQ ID NO: 3305 - DNA, 20 bp, Artificial sequence
  Synthetic oligonucleotide
attaggtcctgggtttttag

SEQ ID NO: 3306 - DNA, 20 bp, Artificial sequence
  Synthetic oligonucleotide
gcattaaatgactgtggtgc

SEQ ID NO: 3307 - DNA, 20 bp, Artificial sequence
  Synthetic oligonucleotide
gtgtttgcattaaatgactg

SEQ ID NO: 3308 - DNA, 20 bp, Artificial sequence
  Synthetic oligonucleotide
actaaatctgaccttcctca

SEQ ID NO: 3309 - DNA, 20 bp, Artificial sequence
  Synthetic oligonucleotide
tggtaagggccactaaatct

SEQ ID NO: 3310 - DNA, 20 bp, Artificial sequence
  Synthetic oligonucleotide
tgatatttctttttttttta

SEQ ID NO: 3311 - DNA, 20 bp, Artificial sequence
  Synthetic oligonucleotide
atgtgtttgatatttctttt

SEQ ID NO: 3312 - DNA, 20 bp, Artificial sequence
  Synthetic oligonucleotide
tgatctaaattgtgtctttt

SEQ ID NO: 3313 - DNA, 20 bp, Artificial sequence
  Synthetic oligonucleotide
gtattataacaatttgcata

SEQ ID NO: 3314 - DNA, 20 bp, Artificial sequence
  Synthetic oligonucleotide
cagggagtattataacaatt

SEQ ID NO: 3315 - DNA, 20 bp, Artificial sequence
  Synthetic oligonucleotide
tcatagaagcattctgtgtt

SEQ ID NO: 3316 - DNA, 20 bp, Artificial sequence
  Synthetic oligonucleotide
gtcattatctagtttctgga

SEQ ID NO: 3317 - DNA, 20 bp, Artificial sequence
  Synthetic oligonucleotide
caaatggtcattatctagtt

SEQ ID NO: 3318 - DNA, 20 bp, Artificial sequence
  Synthetic oligonucleotide
atctgctaggcatgcgggat

SEQ ID NO: 3319 - DNA, 20 bp, Artificial sequence
  Synthetic oligonucleotide
tgatttgtacacacccagca

SEQ ID NO: 3320 - DNA, 20 bp, Artificial sequence
  Synthetic oligonucleotide
gcactgatccaataaaaccc

SEQ ID NO: 3321 - DNA, 20 bp, Artificial sequence
  Synthetic oligonucleotide
cggctgctgttgctctggct

SEQ ID NO: 3322 - DNA, 20 bp, Artificial sequence
  Synthetic oligonucleotide
gtcttgcggctgctgttgct

SEQ ID NO: 3323 - DNA, 20 bp, Artificial sequence
  Synthetic oligonucleotide
ggtgacttgatgcacgatgc

SEQ ID NO: 3324 - DNA, 20 bp, Artificial sequence
  Synthetic oligonucleotide
ccaccctggtgacttgatgc

SEQ ID NO: 3325 - DNA, 20 bp, Artificial sequence
  Synthetic oligonucleotide
taagctatcagttccttgca

SEQ ID NO: 3326 - DNA, 20 bp, Artificial sequence
  Synthetic oligonucleotide
gaaccataagctatcagttc

SEQ ID NO: 3327 - DNA, 20 bp, Artificial sequence
  Synthetic oligonucleotide
ctttcatcacaatggagaac

SEQ ID NO: 3328 - DNA, 20 bp, Artificial sequence
  Synthetic oligonucleotide
taccatgtgctttcatcaca

SEQ ID NO: 3329 - DNA, 20 bp, Artificial sequence
  Synthetic oligonucleotide
aaaactgtaccatgtgcttt

SEQ ID NO: 3330 - DNA, 20 bp, Artificial sequence
  Synthetic oligonucleotide
tttgttcagtttagttgcag

SEQ ID NO: 3331 - DNA, 20 bp, Artificial sequence
  Synthetic oligonucleotide
tcaggtatttgttcagttta

SEQ ID NO: 3332 - DNA, 20 bp, Artificial sequence
  Synthetic oligonucleotide
aaagaaaagtcaggtatttg

SEQ ID NO: 3333 - DNA, 20 bp, Artificial sequence
  Synthetic oligonucleotide
gttggtttagtggatccagt

SEQ ID NO: 3334 - DNA, 20 bp, Artificial sequence
  Synthetic oligonucleotide
cttagtgttggtttagtgga

SEQ ID NO: 3335 - DNA, 20 bp, Artificial sequence
  Synthetic oligonucleotide
agattgttgttattgtatag

SEQ ID NO: 3336 - DNA, 20 bp, Artificial sequence
  Synthetic oligonucleotide
ttcttagagattgttgttat

SEQ ID NO: 3337 - DNA, 20 bp, Artificial sequence
  Synthetic oligonucleotide
ttatggaaattcttagagat

SEQ ID NO: 3338 - DNA, 20 bp, Artificial sequence
  Synthetic oligonucleotide
gtaatgatctgatattaaaa

SEQ ID NO: 3339 - DNA, 20 bp, Artificial sequence
  Synthetic oligonucleotide
tggtgggtaatgatctgata

SEQ ID NO: 3340 - DNA, 20 bp, Artificial sequence
  Synthetic oligonucleotide
gtttttgtgaggtaaaactg

SEQ ID NO: 3341 - DNA, 20 bp, Artificial sequence
  Synthetic oligonucleotide
tgtagtagtttttgtgaggt

SEQ ID NO: 3342 - DNA, 20 bp, Artificial sequence
  Synthetic oligonucleotide
cttggtgcttgtagtagttt

SEQ ID NO: 3343 - DNA, 20 bp, Artificial sequence
  Synthetic oligonucleotide
caccttttctatttgcacta

SEQ ID NO: 3344 - DNA, 20 bp, Artificial sequence
  Synthetic oligonucleotide
tcaaatgtcaccttttctat

SEQ ID NO: 3345 - DNA, 20 bp, Artificial sequence
  Synthetic oligonucleotide
atagcaagtcccctgaagct

SEQ ID NO: 3346 - DNA, 20 bp, Artificial sequence
  Synthetic oligonucleotide
tgatatgctatgctcacaga

SEQ ID NO: 3347 - DNA, 20 bp, Artificial sequence
  Synthetic oligonucleotide
ttagtttgatatgctatgct

SEQ ID NO: 3348 - DNA, 20 bp, Artificial sequence
  Synthetic oligonucleotide
cacagaacactttttccaga

SEQ ID NO: 3349 - DNA, 20 bp, Artificial sequence
  Synthetic oligonucleotide
atcacacagcagcatgttta

SEQ ID NO: 3350 - DNA, 20 bp, Artificial sequence
  Synthetic oligonucleotide
taatcatgttcccgatattg

SEQ ID NO: 3351 - DNA, 20 bp, Artificial sequence
  Synthetic oligonucleotide
ctaacatagttatatttaat

SEQ ID NO: 3352 - DNA, 20 bp, Artificial sequence
  Synthetic oligonucleotide
ggtttatatgtatacaattc

SEQ ID NO: 3353 - DNA, 20 bp, Artificial sequence
  Synthetic oligonucleotide
ttctcaggtttatatgtata

SEQ ID NO: 3354 - DNA, 20 bp, Artificial sequence
  Synthetic oligonucleotide
ttctttgttcataggagaac

SEQ ID NO: 3355 - DNA, 20 bp, Artificial sequence
  Synthetic oligonucleotide
gttcctttcttctttgttca

SEQ ID NO: 3356 - DNA, 20 bp, Artificial sequence
  Synthetic oligonucleotide
acctcttgttcctttcttct

SEQ ID NO: 3357 - DNA, 20 bp, Artificial sequence
  Synthetic oligonucleotide
gtttagatttatcctcagga

SEQ ID NO: 3358 - DNA, 20 bp, Artificial sequence
  Synthetic oligonucleotide
gggtttgtttagatttatcc

SEQ ID NO: 3359 - DNA, 20 bp, Artificial sequence
  Synthetic oligonucleotide
tgtaatactccatttttcct

SEQ ID NO: 3360 - DNA, 20 bp, Artificial sequence
  Synthetic oligonucleotide
caaatgtgtaatactccatt

SEQ ID NO: 3361 - DNA, 20 bp, Artificial sequence
  Synthetic oligonucleotide
ttagtcatttctctctggct

SEQ ID NO: 3362 - DNA, 20 bp, Artificial sequence
  Synthetic oligonucleotide
gtctatgttagtcatttctc

SEQ ID NO: 3363 - DNA, 20 bp, Artificial sequence
  Synthetic oligonucleotide
aaaaatcaagtctatgttag

SEQ ID NO: 3364 - DNA, 20 bp, Artificial sequence
  Synthetic oligonucleotide
atgtttaaggtattttcatg

SEQ ID NO: 3365 - DNA, 20 bp, Artificial sequence
  Synthetic oligonucleotide
acagttatgtttaaggtatt

SEQ ID NO: 3366 - DNA, 20 bp, Artificial sequence
  Synthetic oligonucleotide
aaaacagacttcgatttgga

SEQ ID NO: 3367 - DNA, 20 bp, Artificial sequence
  Synthetic oligonucleotide
gttatttactcattctacct

SEQ ID NO: 3368 - DNA, 20 bp, Artificial sequence
  Synthetic oligonucleotide
aacttggttatttactcatt

SEQ ID NO: 3369 - DNA, 20 bp, Artificial sequence
  Synthetic oligonucleotide
aagttggagaagtcaccagc

SEQ ID NO: 3370 - DNA, 20 bp, Artificial sequence
  Synthetic oligonucleotide
gcatacttagcttttcaaat

SEQ ID NO: 3371 - DNA, 20 bp, Artificial sequence
  Synthetic oligonucleotide
gtgtcagcatacttagcttt

SEQ ID NO: 3372 - DNA, 20 bp, Artificial sequence
  Synthetic oligonucleotide
tcttggaggtgacatttgtg

SEQ ID NO: 3373 - DNA, 20 bp, Artificial sequence
  Synthetic oligonucleotide
gtttttctgtacaaagttca

SEQ ID NO: 3374 - DNA, 20 bp, Artificial sequence
  Synthetic oligonucleotide
tgtttgggtttttctgtaca

SEQ ID NO: 3375 - DNA, 20 bp, Artificial sequence
  Synthetic oligonucleotide
ctttagttttgtttgggttt

SEQ ID NO: 3376 - DNA, 20 bp, Artificial sequence
  Synthetic oligonucleotide
tcaactagttcttatcacta

SEQ ID NO: 3377 - DNA, 20 bp, Artificial sequence
  Synthetic oligonucleotide
acaatgtcaactagttctta

SEQ ID NO: 3378 - DNA, 20 bp, Artificial sequence
  Synthetic oligonucleotide
ttttagttttccttcttgtc

SEQ ID NO: 3379 - DNA, 20 bp, Artificial sequence
  Synthetic oligonucleotide
agattaggtcctgggttttt

SEQ ID NO: 3380 - DNA, 20 bp, Artificial sequence
  Synthetic oligonucleotide
tgcattaaatgactgtggtg

SEQ ID NO: 3381 - DNA, 20 bp, Artificial sequence
  Synthetic oligonucleotide
agtgtttgcattaaatgact

SEQ ID NO: 3382 - DNA, 20 bp, Artificial sequence
  Synthetic oligonucleotide
ccactaaatctgaccttcct

SEQ ID NO: 3383 - DNA, 20 bp, Artificial sequence
  Synthetic oligonucleotide
tccattggtaagggccacta

SEQ ID NO: 3384 - DNA, 20 bp, Artificial sequence
  Synthetic oligonucleotide
tttgatatttcttttttttt

SEQ ID NO: 3385 - DNA, 20 bp, Artificial sequence
  Synthetic oligonucleotide
aatgtgtttgatatttcttt

SEQ ID NO: 3386 - DNA, 20 bp, Artificial sequence
  Synthetic oligonucleotide
cagttttgagatggtttgaa

SEQ ID NO: 3387 - DNA, 20 bp, Artificial sequence
  Synthetic oligonucleotide
agtattataacaatttgcat

SEQ ID NO: 3388 - DNA, 20 bp, Artificial sequence
  Synthetic oligonucleotide
ccagggagtattataacaat

SEQ ID NO: 3389 - DNA, 20 bp, Artificial sequence
  Synthetic oligonucleotide
ctagtttctggaaagtaatg

SEQ ID NO: 3390 - DNA, 20 bp, Artificial sequence
  Synthetic oligonucleotide
ggtcattatctagtttctgg

SEQ ID NO: 3391 - DNA, 20 bp, Artificial sequence
  Synthetic oligonucleotide
aacaaatggtcattatctag

SEQ ID NO: 3392 - DNA, 20 bp, Artificial sequence
  Synthetic oligonucleotide
ccaaattcctggttgctgtg

SEQ ID NO: 3393 - DNA, 20 bp, Artificial sequence
  Synthetic oligonucleotide
agggcctcttggattttgtt

SEQ ID NO: 3394 - DNA, 20 bp, Artificial sequence
  Synthetic oligonucleotide
gcggctgctgttgctctggc

SEQ ID NO: 3395 - DNA, 20 bp, Artificial sequence
  Synthetic oligonucleotide
tgtcttgcggctgctgttgc

SEQ ID NO: 3396 - DNA, 20 bp, Artificial sequence
  Synthetic oligonucleotide
gaccaccctggtgacttgat

SEQ ID NO: 3397 - DNA, 20 bp, Artificial sequence
  Synthetic oligonucleotide
ataagctatcagttccttgc

SEQ ID NO: 3398 - DNA, 20 bp, Artificial sequence
  Synthetic oligonucleotide
agaaccataagctatcagtt

SEQ ID NO: 3399 - DNA, 20 bp, Artificial sequence
  Synthetic oligonucleotide
tgctttcatcacaatggaga

SEQ ID NO: 3400 - DNA, 20 bp, Artificial sequence
  Synthetic oligonucleotide
ggaaaactgtaccatgtgct

SEQ ID NO: 3401 - DNA, 20 bp, Artificial sequence
  Synthetic oligonucleotide
tatttgttcagtttagttgc

SEQ ID NO: 3402 - DNA, 20 bp, Artificial sequence
  Synthetic oligonucleotide
gtcaggtatttgttcagttt

SEQ ID NO: 3403 - DNA, 20 bp, Artificial sequence
  Synthetic oligonucleotide
agtggatccagtcaattcaa

SEQ ID NO: 3404 - DNA, 20 bp, Artificial sequence
  Synthetic oligonucleotide
agagattgttgttattgtat

SEQ ID NO: 3405 - DNA, 20 bp, Artificial sequence
  Synthetic oligonucleotide
attcttagagattgttgtta

SEQ ID NO: 3406 - DNA, 20 bp, Artificial sequence
  Synthetic oligonucleotide
ctgatattaaaacatccagt

SEQ ID NO: 3407 - DNA, 20 bp, Artificial sequence
  Synthetic oligonucleotide
ggtaatgatctgatattaaa

SEQ ID NO: 3408 - DNA, 20 bp, Artificial sequence
  Synthetic oligonucleotide
tatggtgggtaatgatctga

SEQ ID NO: 3409 - DNA, 20 bp, Artificial sequence
  Synthetic oligonucleotide
tagtttttgtgaggtaaaac

SEQ ID NO: 3410 - DNA, 20 bp, Artificial sequence
  Synthetic oligonucleotide
ttgtagtagtttttgtgagg

SEQ ID NO: 3411 - DNA, 20 bp, Artificial sequence
  Synthetic oligonucleotide
ctatttgcactagctgccta

SEQ ID NO: 3412 - DNA, 20 bp, Artificial sequence
  Synthetic oligonucleotide
tcaccttttctatttgcact

SEQ ID NO: 3413 - DNA, 20 bp, Artificial sequence
  Synthetic oligonucleotide
tctcaaatgtcaccttttct

SEQ ID NO: 3414 - DNA, 20 bp, Artificial sequence
  Synthetic oligonucleotide
aaccatatgacatctcaaca

SEQ ID NO: 3415 - DNA, 20 bp, Artificial sequence
  Synthetic oligonucleotide
ttgatatgctatgctcacag

SEQ ID NO: 3416 - DNA, 20 bp, Artificial sequence
  Synthetic oligonucleotide
gttagtttgatatgctatgc

SEQ ID NO: 3417 - DNA, 20 bp, Artificial sequence
  Synthetic oligonucleotide
caactgaaaattctacacac

SEQ ID NO: 3418 - DNA, 20 bp, Artificial sequence
  Synthetic oligonucleotide
cagtagtctccccatagcca

SEQ ID NO: 3419 - DNA, 20 bp, Artificial sequence
  Synthetic oligonucleotide
tttaatcatgttcccgatat

SEQ ID NO: 3420 - DNA, 20 bp, Artificial sequence
  Synthetic oligonucleotide
agttatatttaatcatgttc

SEQ ID NO: 3421 - DNA, 20 bp, Artificial sequence
  Synthetic oligonucleotide
cactaacatagttatattta

SEQ ID NO: 3422 - DNA, 20 bp, Artificial sequence
  Synthetic oligonucleotide
aggtttatatgtatacaatt

SEQ ID NO: 3423 - DNA, 20 bp, Artificial sequence
  Synthetic oligonucleotide
gttctcaggtttatatgtat

SEQ ID NO: 3424 - DNA, 20 bp, Artificial sequence
  Synthetic oligonucleotide
tcttctttgttcataggaga

SEQ ID NO: 3425 - DNA, 20 bp, Artificial sequence
  Synthetic oligonucleotide
caacctcttgttcctttctt

SEQ ID NO: 3426 - DNA, 20 bp, Artificial sequence
  Synthetic oligonucleotide
tgtttagatttatcctcagg

SEQ ID NO: 3427 - DNA, 20 bp, Artificial sequence
  Synthetic oligonucleotide
tccatttttccttctagatt

SEQ ID NO: 3428 - DNA, 20 bp, Artificial sequence
  Synthetic oligonucleotide
gtgtaatactccatttttcc

SEQ ID NO: 3429 - DNA, 20 bp, Artificial sequence
  Synthetic oligonucleotide
tacaaatgtgtaatactcca

SEQ ID NO: 3430 - DNA, 20 bp, Artificial sequence
  Synthetic oligonucleotide
tgttagtcatttctctctgg

SEQ ID NO: 3431 - DNA, 20 bp, Artificial sequence
  Synthetic oligonucleotide
agtctatgttagtcatttct

SEQ ID NO: 3432 - DNA, 20 bp, Artificial sequence
  Synthetic oligonucleotide
gatgataaattaaggcagag

SEQ ID NO: 3433 - DNA, 20 bp, Artificial sequence
  Synthetic oligonucleotide
tatgtttaaggtattttcat

SEQ ID NO: 3434 - DNA, 20 bp, Artificial sequence
  Synthetic oligonucleotide
aacagttatgtttaaggtat

SEQ ID NO: 3435 - DNA, 20 bp, Artificial sequence
  Synthetic oligonucleotide
ctcattctaccttcaactct

SEQ ID NO: 3436 - DNA, 20 bp, Artificial sequence
  Synthetic oligonucleotide
ggttatttactcattctacc

SEQ ID NO: 3437 - DNA, 20 bp, Artificial sequence
  Synthetic oligonucleotide
taaacttggttatttactca

SEQ ID NO: 3438 - DNA, 20 bp, Artificial sequence
  Synthetic oligonucleotide
gagtgagcattagatggtca

SEQ ID NO: 3439 - DNA, 20 bp, Artificial sequence
  Synthetic oligonucleotide
agcatacttagcttttcaaa

SEQ ID NO: 3440 - DNA, 20 bp, Artificial sequence
  Synthetic oligonucleotide
agtgtcagcatacttagctt

SEQ ID NO: 3441 - DNA, 20 bp, Artificial sequence
  Synthetic oligonucleotide
agggaaatggtcattttcta

SEQ ID NO: 3442 - DNA, 20 bp, Artificial sequence
  Synthetic oligonucleotide
gggtttttctgtacaaagtt

SEQ ID NO: 3443 - DNA, 20 bp, Artificial sequence
  Synthetic oligonucleotide
ttgtttgggtttttctgtac

SEQ ID NO: 3444 - DNA, 20 bp, Artificial sequence
  Synthetic oligonucleotide
ttcttatcactattcagtca

SEQ ID NO: 3445 - DNA, 20 bp, Artificial sequence
  Synthetic oligonucleotide
gtcaactagttcttatcact

SEQ ID NO: 3446 - DNA, 20 bp, Artificial sequence
  Synthetic oligonucleotide
aaacaatgtcaactagttct

SEQ ID NO: 3447 - DNA, 20 bp, Artificial sequence
  Synthetic oligonucleotide
gtttttagttttccttcttg

SEQ ID NO: 3448 - DNA, 20 bp, Artificial sequence
  Synthetic oligonucleotide
gtcctgggtttttagttttc

SEQ ID NO: 3449 - DNA, 20 bp, Artificial sequence
  Synthetic oligonucleotide
gaagattaggtcctgggttt

SEQ ID NO: 3450 - DNA, 20 bp, Artificial sequence
  Synthetic oligonucleotide
ttgcattaaatgactgtggt

SEQ ID NO: 3451 - DNA, 20 bp, Artificial sequence
  Synthetic oligonucleotide
cagtgtttgcattaaatgac

SEQ ID NO: 3452 - DNA, 20 bp, Artificial sequence
  Synthetic oligonucleotide
ggccactaaatctgaccttc

SEQ ID NO: 3453 - DNA, 20 bp, Artificial sequence
  Synthetic oligonucleotide
aatccattggtaagggccac

SEQ ID NO: 3454 - DNA, 20 bp, Artificial sequence
  Synthetic oligonucleotide
gtttgatatttctttttttt

SEQ ID NO: 3455 - DNA, 20 bp, Artificial sequence
  Synthetic oligonucleotide
caaatgtgtttgatatttct

SEQ ID NO: 3456 - DNA, 20 bp, Artificial sequence
  Synthetic oligonucleotide
aacaatttgcatagtctctc

SEQ ID NO: 3457 - DNA, 20 bp, Artificial sequence
  Synthetic oligonucleotide
gagtattataacaatttgca

SEQ ID NO: 3458 - DNA, 20 bp, Artificial sequence
  Synthetic oligonucleotide
ttccagggagtattataaca

SEQ ID NO: 3459 - DNA, 20 bp, Artificial sequence
  Synthetic oligonucleotide
atctagtttctggaaagtaa

SEQ ID NO: 3460 - DNA, 20 bp, Artificial sequence
  Synthetic oligonucleotide
ataacaaatggtcattatct

SEQ ID NO: 3461 - DNA, 20 bp, Artificial sequence
  Synthetic oligonucleotide
aatccaaatcttgtattctt

SEQ ID NO: 3462 - DNA, 20 bp, Artificial sequence
  Synthetic oligonucleotide
tctagaaatgattttgatta

SEQ ID NO: 3463 - DNA, 20 bp, Artificial sequence
  Synthetic oligonucleotide
tgggcatttaagaaatgctc

SEQ ID NO: 3464 - DNA, 20 bp, Artificial sequence
  Synthetic oligonucleotide
tgcggctgctgttgctctgg

SEQ ID NO: 3465 - DNA, 20 bp, Artificial sequence
  Synthetic oligonucleotide
atgtcttgcggctgctgttg

SEQ ID NO: 3466 - DNA, 20 bp, Artificial sequence
  Synthetic oligonucleotide
ctggtgacttgatgcacgat

SEQ ID NO: 3467 - DNA, 20 bp, Artificial sequence
  Synthetic oligonucleotide
tggaccaccctggtgacttg

SEQ ID NO: 3468 - DNA, 20 bp, Artificial sequence
  Synthetic oligonucleotide
cataagctatcagttccttg

SEQ ID NO: 3469 - DNA, 20 bp, Artificial sequence
  Synthetic oligonucleotide
gagaaccataagctatcagt

SEQ ID NO: 3470 - DNA, 20 bp, Artificial sequence
  Synthetic oligonucleotide
tgtgctttcatcacaatgga

SEQ ID NO: 3471 - DNA, 20 bp, Artificial sequence
  Synthetic oligonucleotide
tgtaccatgtgctttcatca

SEQ ID NO: 3472 - DNA, 20 bp, Artificial sequence
  Synthetic oligonucleotide
ttggaaaactgtaccatgtg

SEQ ID NO: 3473 - DNA, 20 bp, Artificial sequence
  Synthetic oligonucleotide
ttagtggatccagtcaattc

SEQ ID NO: 3474 - DNA, 20 bp, Artificial sequence
  Synthetic oligonucleotide
ccatcttagtgttggtttag

SEQ ID NO: 3475 - DNA, 20 bp, Artificial sequence
  Synthetic oligonucleotide
tagagattgttgttattgta

SEQ ID NO: 3476 - DNA, 20 bp, Artificial sequence
  Synthetic oligonucleotide
aattcttagagattgttgtt

SEQ ID NO: 3477 - DNA, 20 bp, Artificial sequence
  Synthetic oligonucleotide
catatggtgggtaatgatct

SEQ ID NO: 3478 - DNA, 20 bp, Artificial sequence
  Synthetic oligonucleotide
gtagtttttgtgaggtaaaa

SEQ ID NO: 3479 - DNA, 20 bp, Artificial sequence
  Synthetic oligonucleotide
ttctatttgcactagctgcc

SEQ ID NO: 3480 - DNA, 20 bp, Artificial sequence
  Synthetic oligonucleotide
tgtcaccttttctatttgca

SEQ ID NO: 3481 - DNA, 20 bp, Artificial sequence
  Synthetic oligonucleotide
cctctcaaatgtcacctttt

SEQ ID NO: 3482 - DNA, 20 bp, Artificial sequence
  Synthetic oligonucleotide
ctatgctcacagagaacctg

SEQ ID NO: 3483 - DNA, 20 bp, Artificial sequence
  Synthetic oligonucleotide
tttgatatgctatgctcaca

SEQ ID NO: 3484 - DNA, 20 bp, Artificial sequence
  Synthetic oligonucleotide
cagttagtttgatatgctat

SEQ ID NO: 3485 - DNA, 20 bp, Artificial sequence
  Synthetic oligonucleotide
tgtgatttatcgctgacctt

SEQ ID NO: 3486 - DNA, 20 bp, Artificial sequence
  Synthetic oligonucleotide
gaatggttctcttttacggg

SEQ ID NO: 3487 - DNA, 20 bp, Artificial sequence
  Synthetic oligonucleotide
tatttaatcatgttcccgat

SEQ ID NO: 3488 - DNA, 20 bp, Artificial sequence
  Synthetic oligonucleotide
tagttatatttaatcatgtt

SEQ ID NO: 3489 - DNA, 20 bp, Artificial sequence
  Synthetic oligonucleotide
atgtatacaattctgacagt

SEQ ID NO: 3490 - DNA, 20 bp, Artificial sequence
  Synthetic oligonucleotide
caggtttatatgtatacaat

SEQ ID NO: 3491 - DNA, 20 bp, Artificial sequence
  Synthetic oligonucleotide
atgttctcaggtttatatgt

SEQ ID NO: 3492 - DNA, 20 bp, Artificial sequence
  Synthetic oligonucleotide
tttcttctttgttcatagga

SEQ ID NO: 3493 - DNA, 20 bp, Artificial sequence
  Synthetic oligonucleotide
ttgttcctttcttctttgtt

SEQ ID NO: 3494 - DNA, 20 bp, Artificial sequence
  Synthetic oligonucleotide
aacaacctcttgttcctttc

SEQ ID NO: 3495 - DNA, 20 bp, Artificial sequence
  Synthetic oligonucleotide
ttgtttagatttatcctcag

SEQ ID NO: 3496 - DNA, 20 bp, Artificial sequence
  Synthetic oligonucleotide
actccatttttccttctaga

SEQ ID NO: 3497 - DNA, 20 bp, Artificial sequence
  Synthetic oligonucleotide
attacaaatgtgtaatactc

SEQ ID NO: 3498 - DNA, 20 bp, Artificial sequence
  Synthetic oligonucleotide
atgttagtcatttctctctg

SEQ ID NO: 3499 - DNA, 20 bp, Artificial sequence
  Synthetic oligonucleotide
aagtctatgttagtcatttc

SEQ ID NO: 3500 - DNA, 20 bp, Artificial sequence
  Synthetic oligonucleotide
aggtattttcatggagtttc

SEQ ID NO: 3501 - DNA, 20 bp, Artificial sequence
  Synthetic oligonucleotide
ttatgtttaaggtattttca

SEQ ID NO: 3502 - DNA, 20 bp, Artificial sequence
  Synthetic oligonucleotide
gtaacagttatgtttaaggt

SEQ ID NO: 3503 - DNA, 20 bp, Artificial sequence
  Synthetic oligonucleotide
tactcattctaccttcaact

SEQ ID NO: 3504 - DNA, 20 bp, Artificial sequence
  Synthetic oligonucleotide
cataaacttggttatttact

SEQ ID NO: 3505 - DNA, 20 bp, Artificial sequence
  Synthetic oligonucleotide
ccactaccacccccaaacca

SEQ ID NO: 3506 - DNA, 20 bp, Artificial sequence
  Synthetic oligonucleotide
cagcatacttagcttttcaa

SEQ ID NO: 3507 - DNA, 20 bp, Artificial sequence
  Synthetic oligonucleotide
cagtgtcagcatacttagct

SEQ ID NO: 3508 - DNA, 20 bp, Artificial sequence
  Synthetic oligonucleotide
catgtattgctaggagccag

SEQ ID NO: 3509 - DNA, 20 bp, Artificial sequence
  Synthetic oligonucleotide
tgggtttttctgtacaaagt

SEQ ID NO: 3510 - DNA, 20 bp, Artificial sequence
  Synthetic oligonucleotide
tttgtttgggtttttctgta

SEQ ID NO: 3511 - DNA, 20 bp, Artificial sequence
  Synthetic oligonucleotide
agttcttatcactattcagt

SEQ ID NO: 3512 - DNA, 20 bp, Artificial sequence
  Synthetic oligonucleotide
ctaaacaatgtcaactagtt

SEQ ID NO: 3513 - DNA, 20 bp, Artificial sequence
  Synthetic oligonucleotide
gggtttttagttttccttct

SEQ ID NO: 3514 - DNA, 20 bp, Artificial sequence
  Synthetic oligonucleotide
ggtcctgggtttttagtttt

SEQ ID NO: 3515 - DNA, 20 bp, Artificial sequence
  Synthetic oligonucleotide
aatgactgtggtgcagcctc

SEQ ID NO: 3516 - DNA, 20 bp, Artificial sequence
  Synthetic oligonucleotide
tttgcattaaatgactgtgg

SEQ ID NO: 3517 - DNA, 20 bp, Artificial sequence
  Synthetic oligonucleotide
gccagtgtttgcattaaatg

SEQ ID NO: 3518 - DNA, 20 bp, Artificial sequence
  Synthetic oligonucleotide
agggccactaaatctgacct

SEQ ID NO: 3519 - DNA, 20 bp, Artificial sequence
  Synthetic oligonucleotide
agaatccattggtaagggcc

SEQ ID NO: 3520 - DNA, 20 bp, Artificial sequence
  Synthetic oligonucleotide
ttcaaatgtgtttgatattt

SEQ ID NO: 3521 - DNA, 20 bp, Artificial sequence
  Synthetic oligonucleotide
ataacaatttgcatagtctc

SEQ ID NO: 3522 - DNA, 20 bp, Artificial sequence
  Synthetic oligonucleotide
ttttccagggagtattataa

SEQ ID NO: 3523 - DNA, 20 bp, Artificial sequence
  Synthetic oligonucleotide
ttatctagtttctggaaagt

SEQ ID NO: 3524 - DNA, 20 bp, Artificial sequence
  Synthetic oligonucleotide
atggtcattatctagtttct

SEQ ID NO: 3525 - DNA, 20 bp, Artificial sequence
  Synthetic oligonucleotide
tgataacaaatggtcattat

SEQ ID NO: 3526 - DNA, 20 bp, Artificial sequence
  Synthetic oligonucleotide
catcaaaattgtgcacaatt

SEQ ID NO: 3527 - DNA, 20 bp, Artificial sequence
  Synthetic oligonucleotide
tgaaaacatgttgtgtgatt

SEQ ID NO: 3528 - DNA, 20 bp, Artificial sequence
  Synthetic oligonucleotide
ttgttggattctttttttct

SEQ ID NO: 3529 - DNA, 20 bp, Artificial sequence
  Synthetic oligonucleotide
gacttgatgcacgatgctct

SEQ ID NO: 3530 - DNA, 20 bp, Artificial sequence
  Synthetic oligonucleotide
atgcacgatgctctgtaaag

SEQ ID NO: 3531 - DNA, 20 bp, Artificial sequence
  Synthetic oligonucleotide
tgatgcacgatgctctgtaa

SEQ ID NO: 3532 - DNA, 20 bp, Artificial sequence
  Synthetic oligonucleotide
cttgatgcacgatgctctgt

SEQ ID NO: 3533 - DNA, 20 bp, Artificial sequence
  Synthetic oligonucleotide
tgattgtgttccattgtaaa

SEQ ID NO: 3534 - DNA, 20 bp, Artificial sequence
  Synthetic oligonucleotide
gagttgtccatagtcatgaa

SEQ ID NO: 3535 - DNA, 20 bp, Artificial sequence
  Synthetic oligonucleotide
cgagttgtccatagtcatga

SEQ ID NO: 3536 - DNA, 20 bp, Artificial sequence
  Synthetic oligonucleotide
tgcacttttgtttctacagc

SEQ ID NO: 3537 - DNA, 20 bp, Artificial sequence
  Synthetic oligonucleotide
aggccttgcacttttgtttc

SEQ ID NO: 3538 - DNA, 20 bp, Artificial sequence
  Synthetic oligonucleotide
aagtggcacccgagttgtcc

SEQ ID NO: 3539 - DNA, 20 bp, Artificial sequence
  Synthetic oligonucleotide
gccttgcacttttgtttcta

SEQ ID NO: 3540 - DNA, 20 bp, Artificial sequence
  Synthetic oligonucleotide
gattgtgttccattgtaaac

SEQ ID NO: 3541 - DNA, 20 bp, Artificial sequence
  Synthetic oligonucleotide
gtggatccagtcaattcaat

SEQ ID NO: 3542 - DNA, 20 bp, Artificial sequence
  Synthetic oligonucleotide
aatagcagctatttcatgac

SEQ ID NO: 3543 - DNA, 20 bp, Artificial sequence
  Synthetic oligonucleotide
tggatccagtcaattcaata

SEQ ID NO: 3544 - DNA, 20 bp, Artificial sequence
  Synthetic oligonucleotide
tcaattcaatactcgaagta

SEQ ID NO: 3545 - DNA, 20 bp, Artificial sequence
  Synthetic oligonucleotide
ggatccagtcaattcaatac

SEQ ID NO: 3546 - DNA, 20 bp, Artificial sequence
  Synthetic oligonucleotide
caatgactcttcactcatgt

SEQ ID NO: 3547 - DNA, 20 bp, Artificial sequence
  Synthetic oligonucleotide
actattttcaactcaagctg

SEQ ID NO: 3548 - DNA, 20 bp, Artificial sequence
  Synthetic oligonucleotide
gactcttcactcatgtttat

SEQ ID NO: 3549 - DNA, 20 bp, Artificial sequence
  Synthetic oligonucleotide
ggtactggctcatcagttgt

SEQ ID NO: 3550 - DNA, 20 bp, Artificial sequence
  Synthetic oligonucleotide
aatgactcttcactcatgtt

SEQ ID NO: 3551 - DNA, 20 bp, Artificial sequence
  Synthetic oligonucleotide
agcaatgactcttcactcat

SEQ ID NO: 3552 - DNA, 20 bp, Artificial sequence
  Synthetic oligonucleotide
aagcaatgactcttcactca

SEQ ID NO: 3553 - DNA, 20 bp, Artificial sequence
  Synthetic oligonucleotide
aaccaatctatcacaccaat

SEQ ID NO: 3554 - DNA, 20 bp, Artificial sequence
  Synthetic oligonucleotide
agccatccaagtaagaatat

SEQ ID NO: 3555 - DNA, 20 bp, Artificial sequence
  Synthetic oligonucleotide
accaatctatcacaccaatg

SEQ ID NO: 3556 - DNA, 20 bp, Artificial sequence
  Synthetic oligonucleotide
caatctatcacaccaatgca

SEQ ID NO: 3557 - DNA, 20 bp, Artificial sequence
  Synthetic oligonucleotide
cagccatccaagtaagaata

SEQ ID NO: 3558 - DNA, 20 bp, Artificial sequence
  Synthetic oligonucleotide
tattgtcacatactagttca

SEQ ID NO: 3559 - DNA, 20 bp, Artificial sequence
  Synthetic oligonucleotide
ctgactaatttcttggtgat

SEQ ID NO: 3560 - DNA, 20 bp, Artificial sequence
  Synthetic oligonucleotide
gtggtcatttattgtcacat

SEQ ID NO: 3561 - DNA, 20 bp, Artificial sequence
  Synthetic oligonucleotide
gtcacatactagttcataat

SEQ ID NO: 3562 - DNA, 20 bp, Artificial sequence
  Synthetic oligonucleotide
ttattgtcacatactagttc

SEQ ID NO: 3563 - DNA, 20 bp, Artificial sequence
  Synthetic oligonucleotide
cccgagttgtccatagtcat

SEQ ID NO: 3564 - DNA, 20 bp, Artificial sequence
  Synthetic oligonucleotide
cattgtaaacgcaaaaggcc

SEQ ID NO: 3565 - DNA, 20 bp, Artificial sequence
  Synthetic oligonucleotide
cagtcaattcaatactcgaa

SEQ ID NO: 3566 - DNA, 20 bp, Artificial sequence
  Synthetic oligonucleotide
gtccatagtcatgaactata

SEQ ID NO: 3567 - DNA, 20 bp, Artificial sequence
  Synthetic oligonucleotide
atagcagctatttcatgact

SEQ ID NO: 3568 - DNA, 20 bp, Artificial sequence
  Synthetic oligonucleotide
gtcaattcaatactcgaagt

SEQ ID NO: 3569 - DNA, 20 bp, Artificial sequence
  Synthetic oligonucleotide
gatccagtcaattcaatact

SEQ ID NO: 3570 - DNA, 20 bp, Artificial sequence
  Synthetic oligonucleotide
taaccaatctatcacaccaa

SEQ ID NO: 3571 - DNA, 20 bp, Artificial sequence
  Synthetic oligonucleotide
atgactcttcactcatgttt

SEQ ID NO: 3572 - DNA, 20 bp, Artificial sequence
  Synthetic oligonucleotide
gactattttcaactcaagct

SEQ ID NO: 3573 - DNA, 20 bp, Artificial sequence
  Synthetic oligonucleotide
cttggtggtcatttattgtc

SEQ ID NO: 3574 - DNA, 20 bp, Artificial sequence
  Synthetic oligonucleotide
ggtggtcatttattgtcaca

SEQ ID NO: 3575 - DNA, 20 bp, Artificial sequence
  Synthetic oligonucleotide
tagttgcagccatccaagta

SEQ ID NO: 3576 - DNA, 20 bp, Artificial sequence
  Synthetic oligonucleotide
tggtggtcatttattgtcac

SEQ ID NO: 3577 - DNA, 20 bp, Artificial sequence
  Synthetic oligonucleotide
gttcagtttagttgcagcca

SEQ ID NO: 3578 - DNA, 20 bp, Artificial sequence
  Synthetic oligonucleotide
catactagttcataattcac

SEQ ID NO: 3579 - DNA, 20 bp, Artificial sequence
  Synthetic oligonucleotide
tcgccctgactaatttcttg

SEQ ID NO: 3580 - DNA, 20 bp, Artificial sequence
  Synthetic oligonucleotide
ccctgactaatttcttggtg

SEQ ID NO: 3581 - DNA, 20 bp, Artificial sequence
  Synthetic oligonucleotide
gccctgactaatttcttggt

SEQ ID NO: 3582 - DNA, 20 bp, Artificial sequence
  Synthetic oligonucleotide
cgtgggtgttcgctctctcc

SEQ ID NO: 3583 - DNA, 20 bp, Artificial sequence
  Synthetic oligonucleotide
gcgtgggtgttcgctctctc

SEQ ID NO: 3584 - DNA, 20 bp, Artificial sequence
  Synthetic oligonucleotide
ctcttaccatcaaaggctaa

SEQ ID NO: 3585 - DNA, 20 bp, Artificial sequence
  Synthetic oligonucleotide
tgtggcagcccgtattcctc

SEQ ID NO: 3586 - DNA, 20 bp, Artificial sequence
  Synthetic oligonucleotide
gggtgttcgctctctccctc

SEQ ID NO: 3587 - DNA, 20 bp, Artificial sequence
  Synthetic oligonucleotide
gtgggtgttcgctctctccc

SEQ ID NO: 3588 - DNA, 20 bp, Artificial sequence
  Synthetic oligonucleotide
ccgtattcctcttaccatca

SEQ ID NO: 3589 - DNA, 20 bp, Artificial sequence
  Synthetic oligonucleotide
gtattcctcttaccatcaaa

SEQ ID NO: 3590 - DNA, 20 bp, Artificial sequence
  Synthetic oligonucleotide
cccgtattcctcttaccatc

SEQ ID NO: 3591 - DNA, 20 bp, Artificial sequence
  Synthetic oligonucleotide
ttttcttttcgccctgacta

SEQ ID NO: 3592 - DNA, 20 bp, Artificial sequence
  Synthetic oligonucleotide
tcatttattgtcacatacta

SEQ ID NO: 3593 - DNA, 20 bp, Artificial sequence
  Synthetic oligonucleotide
cacccgagttgtccatagtc

SEQ ID NO: 3594 - DNA, 20 bp, Artificial sequence
  Synthetic oligonucleotide
gtcatttattgtcacatact

SEQ ID NO: 3595 - DNA, 20 bp, Artificial sequence
  Synthetic oligonucleotide
ttttttcttttcgccctgac

SEQ ID NO: 3596 - DNA, 20 bp, Artificial sequence
  Synthetic oligonucleotide
gttgtccatagtcatgaact

SEQ ID NO: 3597 - DNA, 20 bp, Artificial sequence
  Synthetic oligonucleotide
taattcacattcatcccttt

SEQ ID NO: 3598 - DNA, 20 bp, Artificial sequence
  Synthetic oligonucleotide
tcctaacactgcacagaaac

SEQ ID NO: 3599 - DNA, 20 bp, Artificial sequence
  Synthetic oligonucleotide
tccatagtcatgaactataa

SEQ ID NO: 3600 - DNA, 20 bp, Artificial sequence
  Synthetic oligonucleotide
ccatagtcatgaactataaa

SEQ ID NO: 3601 - DNA, 20 bp, Artificial sequence
  Synthetic oligonucleotide
catagtcatgaactataaac

SEQ ID NO: 3602 - DNA, 20 bp, Artificial sequence
  Synthetic oligonucleotide
acagaaaccagcgtgggtgt

SEQ ID NO: 3603 - DNA, 20 bp, Artificial sequence
  Synthetic oligonucleotide
ctgcacagaaaccagcgtgg

SEQ ID NO: 3604 - DNA, 20 bp, Artificial sequence
  Synthetic oligonucleotide
cataattcacattcatccct

SEQ ID NO: 3605 - DNA, 20 bp, Artificial sequence
  Synthetic oligonucleotide
gcacccgagttgtccatagt

SEQ ID NO: 3606 - DNA, 20 bp, Artificial sequence
  Synthetic oligonucleotide
tttttcttttcgccctgact

SEQ ID NO: 3607 - DNA, 20 bp, Artificial sequence
  Synthetic oligonucleotide
actgcacagaaaccagcgtg

SEQ ID NO: 3608 - DNA, 20 bp, Artificial sequence
  Synthetic oligonucleotide
tgtgttccattgtaaacgca

SEQ ID NO: 3609 - DNA, 20 bp, Artificial sequence
  Synthetic oligonucleotide
cctaacactgcacagaaacc

SEQ ID NO: 3610 - DNA, 20 bp, Artificial sequence
  Synthetic oligonucleotide
ttttatcccagtcattggcc

SEQ ID NO: 3611 - DNA, 20 bp, Artificial sequence
  Synthetic oligonucleotide
ccagtcattggcccccaaac

SEQ ID NO: 3612 - DNA, 20 bp, Artificial sequence
  Synthetic oligonucleotide
ttttctgtgcctcctgacct

SEQ ID NO: 3613 - DNA, 20 bp, Artificial sequence
  Synthetic oligonucleotide
gacctctacccttgtgagca

SEQ ID NO: 3614 - DNA, 20 bp, Artificial sequence
  Synthetic oligonucleotide
cactgcacagaaaccagcgt

SEQ ID NO: 3615 - DNA, 20 bp, Artificial sequence
  Synthetic oligonucleotide
ttaatgagaacaaagtctat

SEQ ID NO: 3616 - DNA, 20 bp, Artificial sequence
  Synthetic oligonucleotide
catccaagtaagaatattta

SEQ ID NO: 3617 - DNA, 20 bp, Artificial sequence
  Synthetic oligonucleotide
aacactgcacagaaaccagc

SEQ ID NO: 3618 - DNA, 20 bp, Artificial sequence
  Synthetic oligonucleotide
aatgagaacaaagtctatgt

SEQ ID NO: 3619 - DNA, 20 bp, Artificial sequence
  Synthetic oligonucleotide
gccatccaagtaagaatatt

SEQ ID NO: 3620 - DNA, 20 bp, Artificial sequence
  Synthetic oligonucleotide
gttgcagccatccaagtaag

SEQ ID NO: 3621 - DNA, 20 bp, Artificial sequence
  Synthetic oligonucleotide
ccgagttgtccatagtcatg

SEQ ID NO: 3622 - DNA, 20 bp, Artificial sequence
  Synthetic oligonucleotide
caaagtctatgtggcagccc

SEQ ID NO: 3623 - DNA, 20 bp, Artificial sequence
  Synthetic oligonucleotide
taacactgcacagaaaccag

SEQ ID NO: 3624 - DNA, 20 bp, Artificial sequence
  Synthetic oligonucleotide
cagtttagttgcagccatcc

SEQ ID NO: 3625 - DNA, 17 bp, Artificial sequence
  Synthetic oligonucleotide
cacgcttttattttctg

SEQ ID NO: 3626 - DNA, 17 bp, Artificial sequence
  Synthetic oligonucleotide
ccacgcttttattttct

SEQ ID NO: 3627 - DNA, 17 bp, Artificial sequence
  Synthetic oligonucleotide
tttataacttttctttc

SEQ ID NO: 3628 - DNA, 17 bp, Artificial sequence
  Synthetic oligonucleotide
ctttataacttttcttt

SEQ ID NO: 3629 - DNA, 17 bp, Artificial sequence
  Synthetic oligonucleotide
cctttataacttttctt

SEQ ID NO: 3630 - DNA, 17 bp, Artificial sequence
  Synthetic oligonucleotide
gcctttataacttttct

SEQ ID NO: 3631 - DNA, 17 bp, Artificial sequence
  Synthetic oligonucleotide
tcatttattgtcacata

SEQ ID NO: 3632 - DNA, 17 bp, Artificial sequence
  Synthetic oligonucleotide
catttattgtcacatac

SEQ ID NO: 3633 - DNA, 17 bp, Artificial sequence
  Synthetic oligonucleotide
gtcatttattgtcacat

SEQ ID NO: 3634 - DNA, 17 bp, Artificial sequence
  Synthetic oligonucleotide
ggtcatttattgtcaca

SEQ ID NO: 3635 - DNA, 17 bp, Artificial sequence
  Synthetic oligonucleotide
ccgagttgtccatagtc

SEQ ID NO: 3636 - DNA, 17 bp, Artificial sequence
  Synthetic oligonucleotide
cccgagttgtccatagt

SEQ ID NO: 3637 - DNA, 17 bp, Artificial sequence
  Synthetic oligonucleotide
acccgagttgtccatag

SEQ ID NO: 3638 - DNA, 17 bp, Artificial sequence
  Synthetic oligonucleotide
tcagtttagttgcagcc

SEQ ID NO: 3639 - DNA, 17 bp, Artificial sequence
  Synthetic oligonucleotide
cagtttagttgcagcca

SEQ ID NO: 3640 - DNA, 17 bp, Artificial sequence
  Synthetic oligonucleotide
ttcagtttagttgcagc

SEQ ID NO: 3641 - DNA, 17 bp, Artificial sequence
  Synthetic oligonucleotide
ttcttttttctgtgcct

SEQ ID NO: 3642 - DNA, 17 bp, Artificial sequence
  Synthetic oligonucleotide
cgctttuattttctgat

SEQ ID NO: 3643 - DNA, 17 bp, Artificial sequence
  Synthetic oligonucleotide
ccacgcutttattttct

SEQ ID NO: 3644 - DNA, 17 bp, Artificial sequence
  Synthetic oligonucleotide
cctttauaacttttctt

SEQ ID NO: 3645 - DNA, 17 bp, Artificial sequence
  Synthetic oligonucleotide
catttautgtcacatac

SEQ ID NO: 3646 - DNA, 17 bp, Artificial sequence
  Synthetic oligonucleotide
gtcattuattgtcacat

SEQ ID NO: 3647 - DNA, 17 bp, Artificial sequence
  Synthetic oligonucleotide
ggtcatutattgtcaca

SEQ ID NO: 3648 - DNA, 17 bp, Artificial sequence
  Synthetic oligonucleotide
ccgagtugtccatagtc

SEQ ID NO: 3649 - DNA, 17 bp, Artificial sequence
  Synthetic oligonucleotide
cgagttgtccatagtca

SEQ ID NO: 3650 - DNA, 17 bp, Artificial sequence
  Synthetic oligonucleotide
tttcttutttctgtgcc

SEQ ID NO: 3651 - DNA, 17 bp, Artificial sequence
  Synthetic oligonucleotide
ttctttuttctgtgcct

SEQ ID NO: 3652 - DNA, 17 bp, Artificial sequence
  Synthetic oligonucleotide
cccgagutgtccatagt

SEQ ID NO: 3653 - DNA, 17 bp, Artificial sequence
  Synthetic oligonucleotide
ttcagtutagttgcagc

SEQ ID NO: 3654 - DNA, 17 bp, Artificial sequence
  Synthetic oligonucleotide
tcagttuagttgcagcc

SEQ ID NO: 3655 - DNA, 20 bp, Artificial sequence
  Synthetic oligonucleotide
ttgttcagtttagttgcagc

SEQ ID NO: 3656 - DNA, 17 bp, Artificial sequence
  Synthetic oligonculeotide
gcacccgagttgtccat

SEQ ID NO: 3657 - DNA, 17 bp, Artificial sequence
  Synthetic oligonucleotide
cagcccgtattcctctt

SEQ ID NO: 3658 - DNA, 17 bp, Artificial sequence
  Synthetic oligonucleotide
cacccgagttgtccata

SEQ ID NO: 3659 - DNA, 17 bp, Artificial sequence
  Synthetic oligonucleotide
gagttgtccatagtcat

SEQ ID NO: 3660 - DNA, 17 bp, Artificial sequence
  Synthetic oligonucleotide
cccgtattcctcttacc

SEQ ID NO: 3661 - DNA, 17 bp, Artificial sequence
  Synthetic oligonucleotide
agcccgtattcctctta

SEQ ID NO: 3662 - DNA, 17 bp, Artificial sequence
  Synthetic oligonucleotide
agtttagttgcagccat

SEQ ID NO: 3663 - DNA, 17 bp, Artificial sequence
  Synthetic oligonucleotide
gtattcctcttaccatc

SEQ ID NO: 3664 - DNA, 17 bp, Artificial sequence
  Synthetic oligonucleotide
cgtattcctcttaccat

SEQ ID NO: 3665 - DNA, 17 bp, Artificial sequence
  Synthetic oligonucleotide
tgttcagtttagttgca

SEQ ID NO: 3666 - DNA, 17 bp, Artificial sequence
  Synthetic oligonucleotide
tattcctcttaccatca

SEQ ID NO: 3667 - DNA, 17 bp, Artificial sequence
  Synthetic oligonucleotide
ccgtattcctcttacca

SEQ ID NO: 3668 - DNA, 17 bp, Artificial sequence
  Synthetic oligonucleotide
gcccgtattcctcttac

SEQ ID NO: 3669 - DNA, 17 bp, Artificial sequence
  Synthetic oligonucleotide
ttgttcagtttagttgc

The invention claimed is:

1. A modified oligonucleotide according to the following chemical structure:

(SEQ ID NO: 3590)

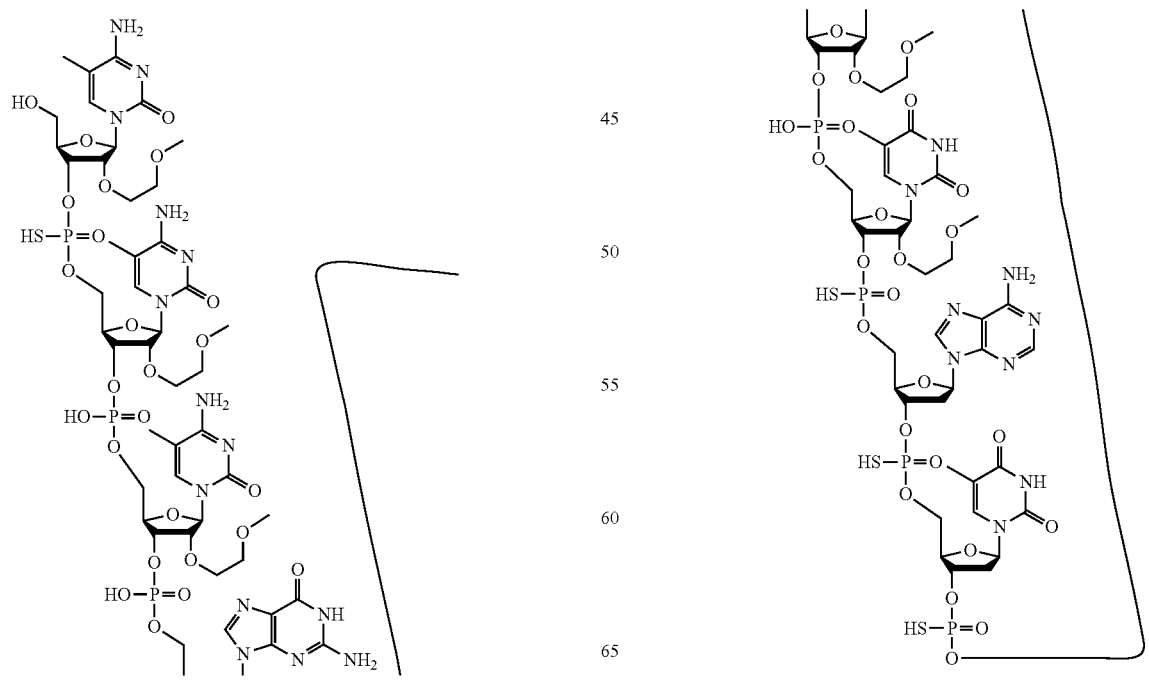

383
-continued
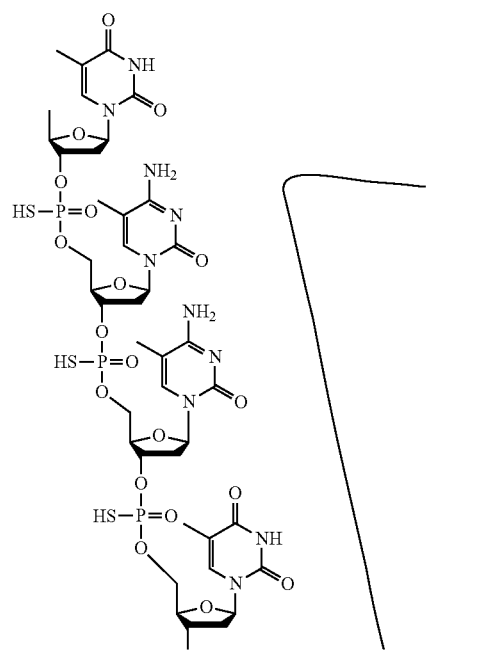
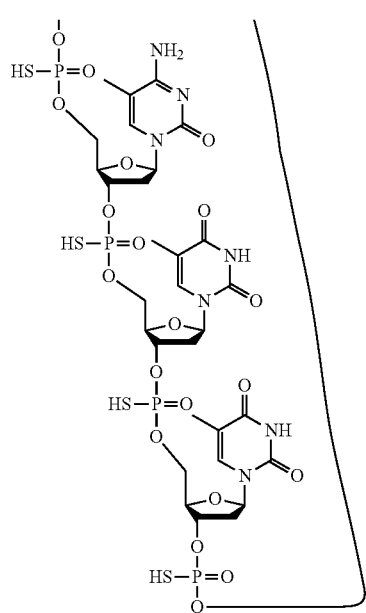
384
-continued
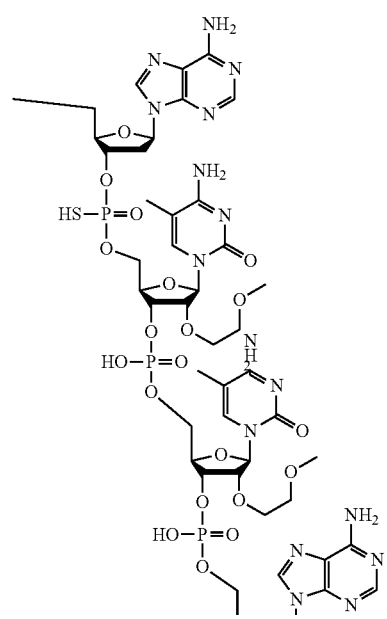
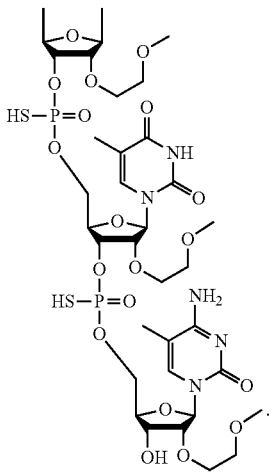
salt thereof.
2. The modified oligonucleotide of claim 1, which is the sodium salt or the potassium salt.
3. A modified oligonucleotide according to the following chemical structure:

(SEQ ID NO: 3590)

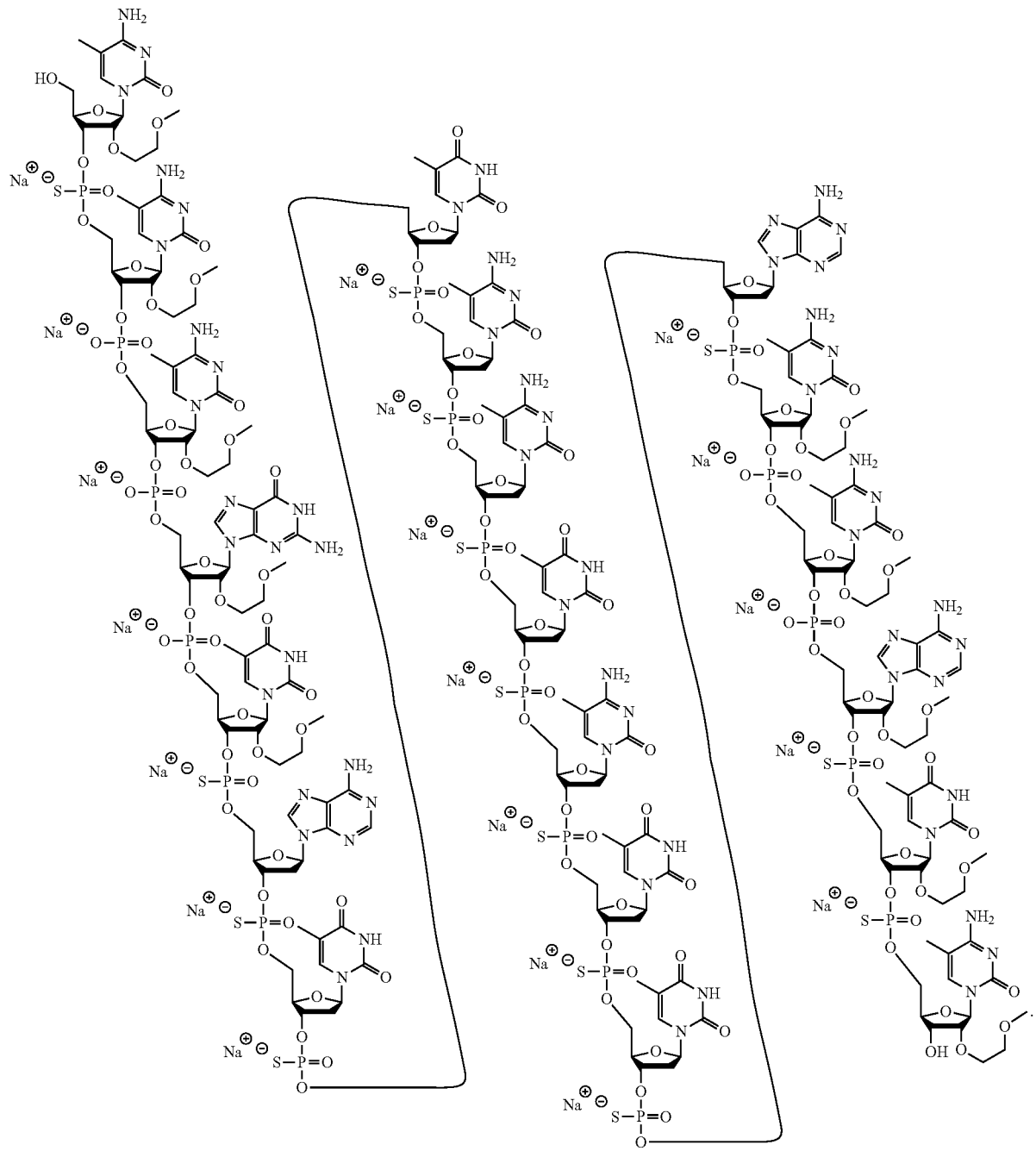

4. An oligomeric compound comprising a modified oligonucleotide according to the following chemical notation:

$^m$Ces $^m$Ceo $^m$Ceo Geo Tes Ads Tds Tds $^m$Cds $^m$Cds Tds $^m$Cds Tds Tds Ads $^m$Ceo $^m$Ceo Aes Tes $^m$Ce (SEQ ID NO: 3590), wherein, A=an adenine nucleobase,
$^m$C=a 5-methylcytosine nucleobase,
G=a guanine nucleobase,
T=a thymine nucleobase,
e=a 2'-MOE sugar moiety,
d=a 2'-β-D deoxyribosyl sugar moiety,
s=a phosphorothioate internucleoside linkage, and
o=a phosphodiester internucleoside linkage.

5. A population of modified oligonucleotides of claim 1, wherein all of the phosphorothioate internucleoside linkages of the modified oligonucleotides are stereorandom.

6. A population of modified oligonucleotides of claim 2, wherein all of the phosphorothioate internucleoside linkages of the modified oligonucleotides are stereorandom.

7. A population of modified oligonucleotides of claim 3, wherein all of the phosphorothioate internucleoside linkages of the modified oligonucleotides are stereorandom.

8. A population of oligomeric compounds of claim 4, wherein all of the phosphorothioate internucleoside linkages of the modified oligonucleotides are stereorandom.

9. A pharmaceutical composition comprising the modified oligonucleotide of claim 1, and a pharmaceutically acceptable diluent.

10. The pharmaceutical composition of claim 9, wherein the pharmaceutically acceptable diluent is phosphate-buffered saline (PBS) or artificial cerebrospinal fluid.

11. The pharmaceutical composition of claim 10, wherein the pharmaceutical composition consists essentially of the modified oligonucleotide and artificial cerebrospinal fluid.

12. The pharmaceutical composition of claim 10, wherein the pharmaceutical composition consists essentially of the modified oligonucleotide and PBS.

13. A pharmaceutical composition comprising the modified oligonucleotide of claim 2, and a pharmaceutically acceptable diluent.

14. The pharmaceutical composition of claim 13, wherein the pharmaceutically acceptable diluent is phosphate-buffered saline (PBS) or artificial cerebrospinal fluid.

15. The pharmaceutical composition of claim 14, wherein the pharmaceutical composition consists essentially of the modified oligonucleotide and artificial cerebrospinal fluid.

16. The pharmaceutical composition of claim 14, wherein the pharmaceutical composition consists essentially of the modified oligonucleotide and PBS.

17. A pharmaceutical composition comprising the modified oligonucleotide of claim 3, and a pharmaceutically acceptable diluent.

18. The pharmaceutical composition of claim 17, wherein the pharmaceutically acceptable diluent is phosphate-buffered saline (PBS) or artificial cerebrospinal fluid.

19. The pharmaceutical composition of claim 18, wherein the pharmaceutical composition consists essentially of the modified oligonucleotide and artificial cerebrospinal fluid.

20. The pharmaceutical composition of claim 18, wherein the pharmaceutical composition consists essentially of the modified oligonucleotide and PBS.

21. A pharmaceutical composition comprising the oligomeric compound of claim 4, and a pharmaceutically acceptable diluent.

22. The pharmaceutical composition of claim 21, wherein the pharmaceutically acceptable diluent is phosphate-buffered saline (PBS) or artificial cerebrospinal fluid.

23. The pharmaceutical composition of claim 22, wherein the pharmaceutical composition consists essentially of the oligomeric compound and artificial cerebrospinal fluid.

24. The pharmaceutical composition of claim 22, wherein the pharmaceutical composition consists essentially of the oligomeric compound and PBS.

25. A pharmaceutical composition comprising the population of modified oligonucleotides of claim 5, and a pharmaceutically acceptable diluent.

26. The pharmaceutical composition of claim 25, wherein the pharmaceutically acceptable diluent is phosphate-buffered saline (PBS) or artificial cerebrospinal fluid.

27. A pharmaceutical composition comprising the population of modified oligonucleotides of claim 7, and a pharmaceutically acceptable diluent.

28. The pharmaceutical composition of claim 27, wherein the pharmaceutically acceptable diluent is phosphate-buffered saline (PBS) or artificial cerebrospinal fluid.

29. A pharmaceutical composition comprising the population of oligomeric compounds of claim 8, and a pharmaceutically acceptable diluent.

30. The pharmaceutical composition of claim 29, wherein the pharmaceutically acceptable diluent is phosphate-buffered saline (PBS) or artificial cerebrospinal fluid.

* * * * *